(12) United States Patent
Brandon et al.

(10) Patent No.: US 8,071,305 B2
(45) Date of Patent: Dec. 6, 2011

(54) MICROARRAY-MEDIATED DIAGNOSIS OF HERPES VIRUS INFECTION BY MONITORING HOST'S DIFFERENTIAL GENE EXPRESSION UPON INFECTION

(75) Inventors: Richard Bruce Brandon, Boonah (AU); Mervyn Rees Thomas, Chapel Hill (AU)

(73) Assignee: Athlomics Pty Ltd., Toowong, Queensland (AU)

( * ) Notice: Subject to any disclaimer, the term of this patent is extended or adjusted under 35 U.S.C. 154(b) by 901 days.

(21) Appl. No.: 11/573,677

(22) PCT Filed: Aug. 15, 2005

(86) PCT No.: PCT/AU2005/001222
§ 371 (c)(1),
(2), (4) Date: Feb. 20, 2008

(87) PCT Pub. No.: WO2006/015452
PCT Pub. Date: Feb. 16, 2006

(65) Prior Publication Data
US 2008/0274988 A1    Nov. 6, 2008

Related U.S. Application Data

(60) Provisional application No. 60/608,141, filed on Sep. 9, 2004.

(30) Foreign Application Priority Data

Aug. 13, 2004   (AU) ................................ 2004904578

(51) Int. Cl.
*C12Q 1/68*        (2006.01)
(52) U.S. Cl. ...................................................... 435/6.11
(58) Field of Classification Search .................. None
See application file for complete search history.

(56) References Cited

FOREIGN PATENT DOCUMENTS
WO    WO 2005/067649 A2    7/2005

OTHER PUBLICATIONS

Jones, J. et al., (2003) J. Virology; vol. 77 No. (2); pp. 1268-1280 "Microarray Analysis of Host Cell Gene Transcription in Response to Varicelle-Zoster Virus Infection of Human T-cells and Fibroblasts in Vitro and in SCIDhu Skin Xenografts in Vivo".
Naranatt, P.P., et al., (2004) Cancer Research; vol. 64; pp. 72-84; "Host Gene Induction and Transcriptional Programming in Kaposi's Sarcoma-Associated Herpesvirus (KSHV/HHV-8)-Infected Endothelial, Fibroblast and B Cells: insights into Modulation Events Early during Infection".
Wilcox and Raidal, 2000, Role of Viruses in Respiratory Disease, RIRDC Publication No. 00/146, RIRDC Project No. UMN-22A.
M. Dunowska, et al., 2002, New Zealand Veterinary Journal vol. 50, No. 4, pp. 132-139, Viruses Associated with Outbreaks of Equine Respiratory Disease in New Zealand.
M. Dunowska, et al., 2002, New Zealand Veterinary Journal vol. 50, No. 4, pp. 140-147, "Equine Respiratory Viruses in Foals in New Zealand".
C. Walker, et al., 1999, Veterinary Microbiology, vol. 68, pp. 3-13, "Comparison of the Pathogenesis of Acute Equine Herpesvirus 1 (EHV-1) Infection in the Horse and the Mouse Model".
M. Espy, et al, 2000, J. Clin Microbiol,. vol. 38. No. 2, pp. 795-799, "Diagnosis of Herpes Simplex Virus Infections in the Clinical Laboratory by LightCycler PCR".
M. Shaw, et al, 2001, Antivir Chem Chemother, vol. 12. No. 3, pp. 175-186, "Ganciclovir and Penciclovir, But Not Acyclovir, Induce Apoptosis in Herpes Simplex Virus Thymidine Kinase-Transformed Baby Hamster Kidney Cells".

*Primary Examiner* — James Martinell
(74) *Attorney, Agent, or Firm* — Perkins Coie LLP

(57) ABSTRACT

The present invention discloses disease-associated molecules and assays, which are useful for diagnosing and assessing those animals with herpes virus infection, and determining those animals at risk of developing an herpes virus infection or its sequelae. The invention has practical use in the early diagnosis of disease, in monitoring an animal's immune response to the disease, and in enabling better treatment and management decisions to be made in clinically and sub-clinically affected animals.

14 Claims, 7 Drawing Sheets

MICROARRAY-MEDIATED DIAGNOSIS OF HERPES VIRUS INFECTION BY MONITORING HOST'S DIFFERENTIAL GENE EXPRESSION UPON INFECTION

FIELD OF THE INVENTION

This invention relates generally to methods and systems for the diagnosis, detection of host response, monitoring, treatment and management of herpes virus infections in mammals. The invention has practical use in the early diagnosis of infection, in the detection of specific immune responses to herpes virus infection (with or without clinical signs), and in enabling better treatment and management decisions to be made in clinically and sub-clinically affected animals. The invention also has practical use in monitoring mammals at risk of developing herpes-related sequelae or relapse of clinical signs following viral latency. Such mammals include, but not be limited to, animals that are immunocompromised (through other disease or administration of therapeutic agents), suffering from chronic fatigue syndrome, stressed, or under athletic training regimens.

BACKGROUND OF THE INVENTION

The herpes viruses represent a large virus family causing widespread disease in man and in domestic and wild animals. There are more than 80 known types of herpes virus, but only eight are known to cause disease in humans. These are divided into three sub-families as shown below.

| 1. Alpha herpes virinae | |
|---|---|
| human herpes virus 1 (HHV-1) | human simplex virus 1 (HSV-1) |
| human herpes virus 2 (HHV-2) | human simplex virus 2 (HSV-2) |
| human herpes virus 3 (HHV-3) | Varicella-Zoster virus (VZV) |
| 2. Beta herpes virinae | |
| human herpes virus 5 (HHV-5) | cytomegalovirus (CMV) |
| human herpes virus 6 (HHV-6) | roseolovirus |
| human herpes virus 7 (HHV-7) | |
| 3. Gamma herpes virinae | |
| human herpes virus 4 (HHV-4) | lymphocryptovirus |
| human herpes virus 8 (HHV-8) | rhadinovirus |

Herpes virus infections are widespread and cause diseases of serious economic importance. In fact, most species of mammals become infected with at least one strain of herpes virus early in life. Infection is permanent, and there are no known cures. Anti-viral agents are available as a treatment but are usually applied and/or taken after symptoms develop (when they are least useful) and do not lend themselves for use as a prophylactic due to side effects and cost. Their use is therefore usually restricted to humans.

Current antibody detection-based diagnostic methods only detect antibody well after clinical signs appear and after the patient is infective to other animals. Other methods of detection involve polymerase chain reaction amplification of viral transcripts or viral DNA, virus isolation in tissue culture and/or virus neutralization assays.

All herpes virus infections are permanent. After a primary infection the virus enters a period of latency. Disease can be reactivated when the patient is immunocompromised or stressed or in advanced athletic training programs. Reactivation of the virus can result in recurrence of symptoms, or general malaise, or decreased exercise tolerance or performance, or it may be asymptomatic.

Determination of the presence of viral antibodies, antigens, or transcripts does not necessarily correlate with the presence of disease or clinical signs.

There are few effective vaccines available.

Drugs are available for treatment but they are costly and for maximum efficacy they need to be given prior to the appearance of major clinical signs.

Epidemiology and Clinical Manifestations

Herpes viruses cause several clinical manifestations in both normal and immunocompromised hosts. Most episodes of herpes virus infections are asymptomatic and most instances in which herpes is transmitted are from people who are unaware, or remain undiagnosed at the time of an outbreak.

Fifty to ninety percent of adult humans possess antibodies to HHV-1 or human simplex virus type 1 (HSV-1); 20%-30% of adults possess antibodies to HHV-2 or human simplex virus type 2 (HSV-2). Prevalence is greater in lower socio-economic groups and in sexually promiscuous individuals. HSV-1 is usually associated with primary infections of the orofacial area and latent infection of the trigeminal ganglion, while HSV-2 is usually associated with genital infections and latent infection in sacral ganglia. Although both primary and recurrent infections are usually self-limited, HSV can cause serious diseases such as neonatal disseminated herpes, viral encephalitis, and blinding keratitis.

During acute primary infection, HSV becomes permanently latent in the nerve root ganglia that correspond to the cutaneous or mucous membrane site of inoculation. In orolabial infection, HSV develops latency in the trigeminal ganglia, whereas latency develops in sacral ganglia after genital or anorectal infection. A variety of stimuli, such as ultraviolet light and trauma to the sensory nerve, may reactivate latent HSV. Recurrent lesions occur at or close to the primary site of infection. Recurrence seems to be related to factors which in some way decrease an individual's disease resistance, such as colds or upper respiratory infections, high levels of physical exercise, sun exposure, stress, menses in women, and in some individuals, trigger foods, particularly large quantities of chocolate or peanuts.

During reactivation, HSV replication occurs within the ganglia, and progeny virions travel peripherally along sensory nerves to the mucosal or epithelial surface innervated by the reactivated ganglion. Active virus replication at the cutaneous surface then produces the clinical signs and lesions typical of recurrent HSV infection (just as is the case with recurrent cold sores in humans infected with HSV).

"Epstein-Barr virus" (EBV) or HHV-4 is associated with infectious mononucleosis, also known as "glandular fever," as well with oncogenesis (e.g., in Burkitt's lymphoma and nasopharyngeocarcinoma). Additionally, EBV is found in immune-suppressed patients and in patients suffering from Hodgkin's disease. EBV occurs worldwide, and most people become infected with EBV sometime during their lives. In the United States, as many as 95% of adults have been infected by the time they are 35-40 years of age. Infants become susceptible to EBV as soon as maternal antibody protection (present at birth) disappears.

EBV symptoms for infectious mononucleosis include fever, sore throat, and swollen lymph glands. Sometimes, a swollen spleen or liver involvement may develop. Heart problems or involvement of the central nervous system occurs only rarely, and infectious mononucleosis is almost never fatal. Most individuals exposed to people with infectious mononucleosis have previously been infected with EBV and are not at risk for infectious mononucleosis. In addition, transmission of EBV requires intimate contact with the saliva (found in the mouth) of an infected person. Transmission of this virus through the air or blood does not normally occur. The incubation period, or the time from infection to appearance of symptoms, ranges from 4 to 6 weeks. Persons with infectious mononucleosis may be able to spread the infection to others for a period of weeks. However, no special precautions or isolation procedures are recommended, since the virus is also found frequently in the saliva of healthy people. In fact, many healthy people can carry and spread the virus intermittently for life. These people are usually the primary reservoir for person-to-person transmission. For this reason, transmission of the virus is almost impossible to prevent.

Although the symptoms of infectious mononucleosis usually resolve in 1 or 2 months, Epstein-Barr virus remains dormant or latent in a few cells in the throat and blood for the rest of the person's life. Periodically, the virus can reactivate and is commonly found in the saliva of infected persons. This reactivation usually occurs without overt symptoms of illness but there may be non-specific symptoms such as malaise or poor athletic performance. EBV also establishes a lifelong dormant infection in some cells of the body's immune system. A late event in a very few carriers of this virus is the emergence of Burkitt's lymphoma and nasopharyngeal carcinoma, two rare cancers that are not normally found in the United States. EBV appears to play an important role in these malignancies, but is probably not the sole cause of disease.

Cytomegalovirus (CMV) or HHV-5 is found universally throughout all geographic locations and socio-economic groups, and infects between 50% and 85% of adults in the United States by 40 years of age. CMV causes infections in the lungs of immune-suppressed persons. In addition, both CMV and EBV are believed to be associated with chronic-fatigue syndrome, a malady that may afflict as many as in six out of every 100,000 people. Infectious CMV may be shed in the bodily fluids of any previously infected person, and thus may be found in urine, saliva, blood, tears, semen, and breast milk. The shedding of virus may take place intermittently, without any detectable signs, and without causing symptoms. Transmission of CMV occurs from person to person. CMV can be sexually transmitted and can also be transmitted via breast milk, transplanted organs, and rarely from blood transfusions. Although the virus is not highly contagious, it has been shown to spread in households and among young children. Transmission of the virus is often preventable because it is most often transmitted through infected bodily fluids that come in contact with hands and then are absorbed through the nose or mouth of a susceptible person. Hence, care should be taken when handling children and items like diapers. Simple hand washing with soap and water is effective in removing the virus from the hands.

CMV, which may have fewer symptoms than EBV, is always followed by a prolonged, unapparent infection during which the virus resides in cells without causing detectable damage or clinical illness. Severe impairment of the body's immune system by medication or disease consistently reactivates the virus from the latent or dormant state. CMV infection without symptoms is common in infants and young children; therefore, it is unjustified and unnecessary to exclude from school or an institution a child known to be infected. Similarly, hospitalized patients do not need separate or elaborate isolation precautions. Screening children and patients for CMV is of questionable value. The cost and management of such procedures are impractical. Children known to have CMV infection should not be singled out for exclusion, isolation, or special handling. Instead, staff education and effective hygiene practices are advised in caring for all children. Circumstances where CMV may be a problem is pregnancy, people who work with infants and children and those who are immunocompromised.

Varicella-Zoster virus (VZV) or HHV-3 causes chickenpox, typically in children, and is acquired by inhaling virus-containing particles, trapped in tiny droplets released into the air from the nose or throat of an infected person. The virus enters the body by infecting cells in the respiratory tract. From here, it spreads to many other parts of the body, including the skin, where it causes the characteristic rash. Each lesion (spot) progresses through a series of characteristic stages over about a week. Papules and vesicles develop into pustules, which then crust over prior to healing. A prominent feature of chickenpox is the development of several crops of spots, such that at the peak of the illness, 3-4 days after first appearance of the rash, there are lesions at all stages of development, from new vesicles through to crusts.

The ability of VZV to spread in this way means that chickenpox is very contagious. Virus excretion from the airways begins in the latter part of the incubation period and continues until all the spots have crusted over. Although the skin vesicles contain virus particles, they are not a major source of contagion. Scabs are not infectious. Time-honored interventions designed to minimize fever and discomfort (i.e., anti-pyretic medicines, cool baths and soothing lotions) are the mainstay of management.

Chickenpox is a clinical manifestation of primary infection with VZV. After recovery from primary infection, VZV is not eliminated from the body but rather, the virus lies dormant (latent), often for decades, in the roots of sensory nerves, in the spinal cord. When the infection is reactivated, it causes pain and a rash in the area supplied by the affected sensory nerves. Latent infection may result is an episode of shingles. This usually happens in older people, perhaps because, with advancing age, the immune system fails to keep the virus in check. The rash of shingles contains VZV particles, just like the rash of chickenpox. Shingles, therefore, carries a small risk of transmitting chickenpox to someone who has not had chickenpox before. Typically, an infant might acquire chickenpox by very close contact with a grandparent with shingles, but the risk of transmission is low, because VZV is not excreted from the throat during shingles.

Roseolovirus or HHV-6 is associated with "roseola" and "infantum" infections in children and with immunocompromised patients. For example, AIDS patients exhibit HHV-6 infection, although the significance of the HHV-6 infection is unclear. HHV-6 is susceptible to antiviral drugs. It is unclear, however, how antiviral drugs work against HHV-6 or how resistance to such drugs develops. A significant aspect of HHV-6 infection is its putative tie-in with multiple sclerosis and chronic fatigue syndrome, respectively.

Less is known about HHV-7 and HHV-8 (rhadinovirus). No clear evidence for the direct involvement of HHV-7 in any human disease has been reported. Studies indicate, however, that HHV-7 may be associated with HHV-6-related infections. In a related vein, HHV-8 infection is believed to be associated with Karposi's sarcoma.

In addition, herpes viruses are regarded as an important cause of wastage in the horse industry and a cause of serious compromise to athletic ability. Veterinarians, trainers and owners tend to manage horses with respiratory disease on experience alone because of the lack of clinical guides and laboratory procedures, and because there is little understanding of the relationship between viral and secondary bacterial infection and duration of disease. Alternative diagnosis or assessment procedures are often complex, invasive, inconvenient, expensive, time consuming, may expose an animal to risk of injury from the procedure, and often require transport of the animal to a diagnostic center.

In a study performed in Western Australia, herpes viruses could be isolated from the blood of 48% of horses with respiratory problems or poor performance. However, herpes viruses could also be isolated from blood of 54% of horses without clinical signs, leading to the conclusion that the presence of the virus in blood cells is not a determinant of disease. Virus isolation from nasal swabs is more indicative of respiratory infection but can only be isolated in 50% of clinical cases. It has been reported that up to 75% of horses in Britain carry the virus.

Equine rhinopneumonitis and equine abortion are commonly recognized diseases of horses caused by two distinct but antigenically-related viruses that are designated equine herpes virus type 4 (EHV-4) and equine herpes virus type 1 (EHV-1). EHV-1 is a cause of epidemic abortion, perinatal mortality, respiratory disease and, occasionally, neurological signs in horses. Abortion is the most dramatic and frightening outcome of EHV-1 infection and can be financially disastrous for breeders, with loss of clients and large insurance pay-outs. Respiratory illness caused by EHV-1, or the closely related EHV-4, can adversely affect racing performance.

The epidemiology of EHV-1 infection within the horse industry has been demonstrated by studies performed on studs in the Hunter Valley, Australia where it was demonstrated that foals are often infected with EHV-1 before 60 days of age. A separate study performed in the USA showed that 85% of foals had seroconverted by 6-8 months postweaning. It is believed that foals become infected through exposure to respiratory droplets from mares or cohort foals.

EHV-1 is a DNA alphaherpes virus with a predilection for epithelial cells of the respiratory tract. The virus can be spread around the body to other organs by cells of the immune system. Because the viruses are related antigenically it has not been possible to date by serological examination (blood test), to determine whether a horse has been infected with either or both EHV-4 or EHV-1. For example, if a horse had been infected with EHV-4 as a foal it would develop antibodies in its serum that would react not only to EHV-4 but EHV-1 as well, so one would not know that such a foal had been infected with only EHV-4. EHV-4 has only been demonstrated to cause respiratory illness, whereas EHV-1 also causes neurological and reproductive disorders (Wilcox and Raidal, 2000, "Role of viruses in respiratory disease" RIRDC Publication No 00/146, RIRDC Project No UMU-22A; Dunowska et al., 2002, *New Zealand Veterinary Journal* 50 (4):132-139; Dunowska et al., 2002, *New Zealand Veterinary Journal* 50 (4):140-147).

EHV-1 has been shown to have a persistent, lifelong latent, infection where reactivation causes further spells of respiratory disease in the horse. However, a far more serious consequence for other horses infected by contact with the first horse (index case) occurs on breeding farms when a pregnant mare in a paddock reactivates the virus and transmits it to other in-contact pregnant mares. The index case mare may herself abort or cause abortion in one or more in contact mares. An aborted fetus and the fetal membranes and fluids are heavily infected with EHV-1 and contaminate the site where abortion occurs. Other mares in the paddock, being naturally curious, come to the site of abortion and sniff the fetus and membranes. In this way, often close to 100% of the mares in the paddock become infected and abort within 10 or 20 days causing what is commonly known as an "abortion storm". Such outbreaks of EHV-1 abortion are of considerable economic importance to the equine, particularly Thoroughbred and Standardbred, industries worldwide.

Immunity and Diagnosis

Herpes viruses induce a strong humoral antibody response, although the effectiveness of this response in protecting the host is questionable. Protection ultimately is afforded through cell-mediated mechanisms, such as cytotoxic lymphocytes and natural killer cells. One of the key features of herpes virus infection is life-long persistent infection and latency. The virus remains in the cell nucleus and can be isolated from many organs long after clinical signs have abated. Thus, where a patient presents with non-descript clinical signs, such as poor performance or malaise, virus can be isolated from tissues but it is not clear that activation of the virus is the cause of the symptoms. Stress or other factors can lead to activation of the dormant virus and concomitant clinical signs (Walker et al., 1999, *Veterinary Microbiology* 68:3-13).

Infection with HSV-1 or HSV-2 induces cell-mediated immunity and the production of type-common and type-specific antibodies. Although these immune mechanisms apparently do not affect the development of HSV latency or the frequency of recurrences, they may modulate the severity of clinical recurrences and reduce HSV replication once reactivation occurs.

The host immune response elicited by HSV-1 or HSV-2 infection appears to provide partial protection against subsequent infection with HSV, as resistance to autologous infection is usually observed in HSV-infected individuals. Additionally, persons with HSV infection usually have a more mild clinical illness when infected with the alternate HSV type as compared with persons with no prior HSV infection.

HSV is the most frequently detected virus in diagnostic laboratories. Diagnosis can be made by virus isolation, polymerase chain reaction (PCR) (Espy et al., 2000, *J Clin Microbiol.* 38 (2):795-799) and histopathology. None of these methods are useful in the control and monitoring of the disease. Other laboratory tests available for diagnosis include specially treated scrapings that are examined under the microscope, and blood tests for antibodies. Some tests are only valid in the early stages, and more than one of these tests may be required to confirm the presence of herpes. Genital herpes can be mistaken for other diseases, including syphilis. High serum antibody levels are also an indication of a recent infection. If a person does experience visible symptoms, a culture test within the first 48 hours after symptoms appear is recommended. Beyond 48 hours, there is a risk of receiving a false negative test result because symptoms may have begun to heal and there is not enough virus left on the skin to culture.

Blood tests can be used when a person has no visible symptoms but has concerns about having herpes. Blood tests do not actually detect the virus; instead, they look for antibodies (the body's immune response) but 50 to 90% of humans have positive antibodies in the blood. There are currently two blood tests available that can give accurate results for herpes. Like any blood test, these tests cannot determine whether the site of infection is oral or genital. However, since most cases of genital herpes are caused by HSV-2, a positive result for type-2 antibodies most likely indicates genital herpes. For the most accurate result; it is recommended to wait at least 12-16 weeks from the last possible exposure to herpes to allow enough time for antibodies to develop.

The clinical diagnosis of EBV and infectious mononucleosis is suggested on the basis of the symptoms of fever, sore throat, swollen lymph glands, and the age of the patient. Usually, laboratory tests are needed for confirmation. Serologic results for persons with infectious mononucleosis include an elevated white blood cell count, an increased percentage of certain atypical white blood cells, and a positive reaction to a "mono spot" test.

Clinical diagnosis of CMV is by the enzyme-linked immunosorbent assay (or ELISA), a serologic test for measuring antibodies. The result can be used to determine if acute infection, prior infection, or passively acquired maternal antibody in an infant is present. Other tests include various fluorescence assays, indirect hemagglutination, and latex agglutination.

Diagnosis of EHV is based on respiratory symptoms i.e. cough or nasal discharge. However, it is important to distinguish between respiratory bacterial or viral infections; exercise induced pulmonary hemorrhage and allergy. Cost of misdiagnosis is large. Costs to owners to diagnose the condition include transport, veterinary advice and pathology tests. Respiratory disease can kill quickly, create life-long disability, impede performance or require long periods of rest. Horses in an active carrier state can re-infect other animals.

Using the horse industry as an example, there is a need for accurate, type-specific serological surveillance of horses for the presence of EHV-4 and/or EHV-1 antibodies to assist in our understanding of the epidemiology of these viruses, particularly EHV-1. EHV-1 infections are difficult to diagnose and treat, and any useful information on how to manage horses with the disease would be welcomed by the industry. Presently, however, EHV-1 or EHV-4 antibodies in polyclonal serum cannot be differentiated because of the extensive antigenic cross-reactivity between the two viruses. The availability of such a specific serological test would also have profound implications in the control, perhaps eradication, of EHV-1 and in the selection of candidate horses for vaccination. Although there is a short lived period following infection when horses are protected against EHV-1 there is generally not a sufficiently high level of long-term immunity to consistently protect against EHV-1 disease. Horses can therefore be re-infected several times during their lifetime, and vaccination strategies are complicated by the ability of herpes viruses to establish a lifelong latent infection in the host animal.

There is no vaccine that prevents HSV disease from occurring. Although several protein subunit vaccines based on HSV-2 envelope glycoproteins have reached advanced-phase clinical trials. These antigens were chosen because they are the targets of neutralizing-antibody responses and because they elicit cellular immunity.

Oral anti-viral medications such as acyclovir, famcyclovir, or valacyclovir have been developed to effectively treat herpes infections. These medications can be used to treat an outbreak or can be used for suppressing herpes recurrences. Lower doses may be helpful in reducing the number of herpes attacks in people with frequent outbreaks. Gancyclovir, penciclovir and acyclovir are effective inhibitors of herpes simplex virus types 1 (HSV-1) and 2 (HSV-2). This antiviral therapy is expensive and needs to be given upon onset of the earliest clinical signs. These antiviral therapies are based on the use of suicide genes, such as the thymidine kinase gene. The efficacies of gancyclovir, pencyclovir and acyclovir in inducing cell death in the herpes simplex virus thymidine kinase (HSVTK) system have been compared (Shaw et al. 2001, *Antivir Chem. Chemother.* 12 (3):175-86). All compounds delay growth or reduced viability of HSVTK-transformed cells.

There is no specific treatment for EBV and infectious mononucleosis, other than treating the symptoms. No antiviral drugs or vaccines are available. Some physicians have prescribed a 5-day course of steroids to control the swelling of the throat and tonsils. The use of steroids has also been reported to decrease the overall length and severity of illness, but these reports have not been published. Finally, even when EBV antibody tests, such as the early antigen test, suggest that reactivated infection is present, this result does not necessarily indicate that a patient's current medical condition is caused by EBV infection. A number of healthy people with no symptoms have antibodies to the EBV early antigen for years after their initial EBV infection.

Currently, no treatment exists for CMV infection in the healthy individual. Antiviral drug therapy is now being evaluated in infants. Gancyclovir treatment is used for patients with depressed immunity and who have either sight-related or life-threatening illnesses. Vaccines are still in the research and development stage.

Chickenpox is not usually treated with a specific antiviral compound owing to its short duration and generally mild, uncomplicated nature. Some doctors believe that antiviral medication may be appropriate for older patients, in whom the disease tends to be more severe. A vaccine for chicken pox (varicella vaccine) has been available since 1995. Studies show that the varicella vaccine is 85% effective in preventing disease. The vaccine may be beneficial to non-immune adults, in particular those at high risk, for example child care and health workers. Because most adults are immune, checking serological status before vaccination is recommended.

The principal challenge in the management of shingles is rapid resolution of pain. Four factors independently increase the risk of persistent pain: advancing age, severe or moderately severe pain at the time the rash appears (called acute pain), pain before the rash appears (called prodromal pain) and failure to obtain adequate antiviral treatment within three days of appearance of the rash. Pain, particularly persistent pain, is thought to be largely the result of virus-induced damage to the affected nerve. The rationale behind the use of antiviral agents is simple: by stopping virus replication as quickly as possible, nerve damage is minimized. Shingles does respond to oral anti-viral medications, namely acyclovir, famciclovir and valacyclovir.

Early identification of EHV-1 infection, especially viral abortion, is important in managing horses so that cyclic re-infection of susceptible horses and relapse do not occur. The cost of EHV infection to the horse industry is large through lost training days, re-infection and recurrent illness, abortions and poor performance. Treatment largely depends on accurate diagnosis. Vaccines are available that elicit strong humoral immune responses, but these are not fully protective. Breakthrough infections commonly occur in vaccinated animals. Despite the availability of vaccines it is generally known that they afford little protection, and breakthrough infections commonly occur in vaccinated animals. Antibiotic treatment only prevents secondary bacterial infection.

Currently, methods for diagnosing herpes virus and associated diseases in the blood are based on antibody-antigen quantitation or detection of viral genetic information (e.g., by polymerase chain reaction). For example, U.S. Pat. No. 6,506,553 describes an assay for diagnosis of EBV and associated diseases by detecting antigen antibodies in a blood sample. The assay detects IgG and IgM antibodies to the diffuse (EA-D) and restricted (EA-R) components of the early antigen of EBV in blood, and more specifically in serum. This assay can be used for diagnosis of EBV-associated disease; such as infectious mononucleosis (IM) for example, and can also be utilized to distinguish between individuals in the acute versus the convalescent phase of disease. However this patent describes a method for the detection of early antigen antibodies, not virus or immune reaction to the virus.

U.S. Pat. No. 6,537,555 describes a composition and method for the diagnosis and treatment of HSV infection based on the detection of HSV antigens. This patent, however, does not describe a method for the detection of virus or immune reaction to the virus.

International Publication WO 99/45155 describes a method for gene expression and molecular diagnostic approaches for the amplification and detection of EBV nucleic acid, in particular RNA-specific sequences. This method is specifically suited for the detection of late stage infection of EBV gene expression in circulating peripheral blood cells, in human (tumour) tissue samples and thin sections thereof using "in solution" amplification or "in situ" amplification techniques and in other biological samples potentially containing EBV-infected cells. However, this method only detects viral transcripts and is most suitable for late stage disease diagnosis. It also does not detect the immune reaction to viral infection, which causes the earliest symptoms of malaise, fever and swollen lymph nodes.

U.S. Patent Application Publication 20040072147 discloses the use of a probe oligonucleotide and at least two primer oligonucleotides for selectively directing the amplification of the target segment of a particular herpes virus type or strain including: HSV-1, drug resistant HSV-1, HSV-2, drug resistant HSV-2, VZV, EBV (HHV-4a and HHV-4b), CMV, lymphocryptovirus (HHV-6a, HHV-6b), HHV-7, and rhadinovirus (HHV-8). However, this method does not provide any insight into the stage of disease or when the animal was infected, or whether the disease is active.

U.S. Pat. No. 6,193,983 describes a method for detecting EHV-4 and EHV-1 type-specific glycoproteins for clinical applications associated with the characterization of such glycoproteins. This method detects specific antibodies to EHV-1 and EHV-4 but it is well known that most horses are exposed to these viruses at an early age and antibody titres persist for some time. Thus, this method provides no insight into the stage of disease or when the animal was infected, or whether the disease is active.

In summary, infection with various strains of herpes virus is a widespread phenomenon in the community and causes disease of serious economic importance. Most humans and domestic animals become infected with at least one strain of herpes virus at an early age and the infection is life-long. Herpes viruses enter a stage of latency and can be reactivated causing a recurrence of symptoms. Often reactivation of the virus can be asymptomatic, but can manifest as malaise or as non-specific symptoms such as low grade fever, lethargy, chronic fatigue, poor exercise tolerance, or poor athletic performance. Physiological stress (such as heavy exercise, concurrent disease, mental stress), or where the immune system is compromised (for example HIV infection, immunosuppressive therapy) can lead to reactivation of herpes viruses leading to chronic symptoms of infection. For these reasons, it is often important to monitor herpes virus infections, especially in immunocompromised patients or elite athletes. Current antibody-based diagnostic methods do not lend themselves to monitoring herpes virus infections because they measure serum antibodies that become elevated 7-14 days following infection and remain elevated due to viral latency. Other current diagnostic methods, such as virus isolation and PCR, do not lend themselves to monitoring as they are laborious or the viral genome is not consistently present in blood cells. Results derived from current diagnostic methods do not correlate with the timing of onset of clinical signs. For example, antibodies can first be detected 10-14 days following initial infection and persist for long periods. A single antibody measurement does not indicate when infection occurred or the level of disease activity and measuring viral transcripts or viral proteins also does not indicate the level of disease activity. The immune system of the host is ultimately responsible for protection from viral invasion. It is the immune response, rather than the virus itself, that is responsible for clinical signs of disease. A more appropriate monitoring tool for herpes virus infection would be one that measured specific host immune reactions to infection.

As such, there currently exists a need for more effective modalities for diagnosing herpes virus infections, for determining active herpes virus infection through host immune response, and for identifying animals amenable to treatment or prophylactic therapy with antiviral agents. Primary infection leads to latent infection in all cases and, as such, there is often the risk of relapse in immunocompromised patients. In such cases, symptoms may or may not be evident, detectable or communicable. Accordingly, there is currently a need for better processes and reagents for assessing and monitoring mammals at risk of herpes virus infection and/or relapse.

SUMMARY OF THE INVENTION

The present invention discloses methods and systems for detecting herpes virus infections, especially active herpes virus infections. A predictive set of genes in cells of the immune system for herpes virus infection has been identified and is described. These genes and their gene products can be used in gene expression assays, protein expression assays, whole cell assays, and in the design and manufacture of therapies. They can also be used to determine infection in animals with or without clinical signs of disease. It is proposed that such assays, when used frequently as an indicator of response to viral activity, will lead to better management decisions and treatment regimes including use with elite athletes or immunocompromised patients.

The present invention represents a significant advance over current technologies for the management of affected animals. In certain advantageous embodiments, it relies upon measuring the level of certain markers in cells, especially circulating leukocytes, of the host rather than detecting viral products or anti-viral antibodies. As such, these methods are suitable for widespread screening of symptomatic and asymptomatic animals. In certain embodiments where circulating leukocytes are the subject of analysis, the detection of a host response to herpes virus infection, especially infection with EHV, is feasible at very early stages of its progression, before herpes virus-specific antibodies can be detected in serum.

Thus, the present invention addresses the problem of diagnosing herpes virus infection by detecting a host response to herpes virus that may be measured in host cells. Advantageous embodiments involve monitoring the expression of certain genes in peripheral leukocytes of the immune system, which may be reflected in changing patterns of RNA levels or protein production that correlate with the presence of herpes virus infection.

Accordingly, in one aspect, the present invention provides methods for diagnosing the presence of a herpes virus infection, particularly an active herpes virus infection, in a test subject, especially in an equine test subject. These methods generally comprise detecting in the test subject aberrant expression of at least one gene (also referred to herein as an "herpes virus infection marker gene" or an "HVI marker gene") selected from the group consisting of: (a) a gene having a polynucleotide expression product comprising a nucleotide sequence that shares at least 50% (and at least 51% to at least 99% and all integer percentages in between) sequence identity with the sequence set forth in any one of SEQ ID NO: 1, 2, 4, 6, 7, 8, 10, 12, 13, 15, 17, 19, 21, 23, 24, 25, 26, 27, 29, 31, 33, 34, 35, 37, 38, 39, 41, 43, 45, 47, 49, 51, 53, 55, 57, 59, 61, 63, 65, 66, 67, 69, 71, 73, 75, 76, 77, 79, 81, 83, 84, 85, 87, 89, 91, 93, 94, 96, 98, 99, 100, 101, 102, 104, 106, 107, 108, 109, 111 or 113 (see Table 1), or a complement thereof; (b) a gene having a polynucleotide expression product comprising a nucleotide sequence that encodes a polypeptide comprising the amino acid sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114 (see Table 1); (c) a gene having a polynucleotide expression product comprising a nucleotide sequence that encodes a polypeptide that shares at least 50% (and at least 51% to at least 99% and all integer percentages in between) sequence similarity with at least a portion of the sequence set forth in SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114, wherein the portion comprises at least 15 contiguous amino acid residues of that sequence; and (d) a gene having a polynucleotide expression product comprising a nucleotide sequence that hybridizes to the sequence of (a), (b), (c) or a complement thereof, under at least low, medium, or high stringency conditions. In accordance with the present invention, these HVI marker genes are aberrantly expressed in animals with a herpes virus infection or a condition related to herpes virus infection, illustrative examples of which include immune suppression, stress, intense athletic training, concurrent infections and idiopathic conditions.

As used herein, polynucleotide expression products of HVI marker genes are referred to herein as "herpes virus infection marker polynucleotides" or "HVI marker polynucleotides." Polypeptide expression products of HVI marker genes are referred to herein as "herpes virus infection marker" or "HVI marker polypeptides."

Thus, in some embodiments, the methods comprise detecting aberrant expression of an HVI marker polynucleotide selected from the group consisting of (a) a polynucleotide comprising a nucleotide sequence that shares at least 50% (and at least 51% to at least 99% and all integer percentages in between) sequence identity with the sequence set forth in any one of SEQ ID NO: 1, 2, 4, 6, 7, 8, 10, 12, 13, 15, 17, 19, 21, 23, 24, 25, 26, 27, 29, 31, 33, 34, 35, 37, 38, 39, 41, 43, 45, 47, 49, 51, 53, 55, 57, 59, 61, 63, 65, 66, 67, 69, 71, 73, 75, 76, 77, 79, 81, 83, 84, 85, 87, 89, 91, 93, 94, 96, 98, 99, 100, 101, 102, 104, 106, 107, 108, 109, 111 or 113, or a complement thereof; (b) a polynucleotide comprising a nucleotide sequence that encodes a polypeptide comprising the amino acid sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114 wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In other embodiments, the methods comprise detecting aberrant expression of an HVI marker polypeptide selected from the group consisting of: (i) a polypeptide comprising an amino acid sequence that shares at least 50% (and at least 51% to at least 99% and all integer percentages in between) sequence similarity with the sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114; (ii) a polypeptide comprising a portion of the sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114, wherein the portion comprises at least 5 contiguous amino acid residues of that sequence; (iii) a polypeptide comprising an amino acid sequence that shares at least 30% similarity with at least 15 contiguous amino acid residues of the sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114; and (iv) a polypeptide comprising a portion of the sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114, wherein the portion comprises at least 5 contiguous amino acid residues of that sequence and is immuno-interactive with an antigen-binding molecule that is immuno-interactive with a sequence of (i), (ii) or (iii).

Typically, such aberrant expression is detected by: (1) measuring in a biological sample obtained from the test subject the level or functional activity of an expression product of at least one HVI marker gene and (2) comparing the measured level or functional activity of each expression product to the level or functional activity of a corresponding expression product in a reference sample obtained from one or more normal subjects or from one or more subjects lacking disease (e.g., subjects lacking active infection), wherein a difference in the level or functional activity of the expression product in the biological sample as compared to the level or functional activity of the corresponding expression product in the reference sample is indicative of the presence of an herpes virus infection or related condition in the test subject. In some embodiments, the methods further comprise diagnosing the presence, stage or degree of an herpes virus infection or related condition in the test subject when the measured level or functional activity of the or each expression product is different than the measured level or functional activity of the or each corresponding expression product. In these embodiments, the difference typically represents an at least about 10%, 20%, 30%, 40%, 50%, 60%, 70%, 80% or 90%, or even an at least about 100%, 200%, 300%, 400%, 500%, 600%, 700%, 800%, 900% or 1000% increase, or an at least about 10%, 20%, 30% 40%, 50%, 60%, 70%, 80%, 90%, 92%, 94%, 96%, 97%, 98% or 99%, or even an at least about 99.5%, 99.9%, 99.95%, 99.99%, 99.995% or 99.999% decrease in the level or functional activity of an individual expression product as compared to the level or functional activity of an individual corresponding expression product, which is hereafter referred to as "aberrant expression." In illustrative examples of this type, the presence of an herpes virus infection or related condition is determined by detecting a decrease in the level or functional activity of at least one HVI marker polynucleotide selected from (a) a polynucleotide comprising a nucleotide sequence that shares at least 50% (and at least 51% to at least 99% and all integer percentages in between) sequence identity with the sequence set forth in any one of SEQ ID NO: 6, 10, 19, 24, 25, 29, 33, 34, 35, 37, 38, 41, 53, 57, 61, 63, 65, 66, 73, 77, 83, 89, 93, 94, 96, 100, 101, 102, 104, 106, 107 or 108, or a complement thereof;

(b) a polynucleotide comprising a nucleotide sequence that encodes a polypeptide comprising the amino acid sequence set forth in any one of SEQ ID NO: 11, 20, 30, 36, 42, 54, 58, 62, 64, 74, 78, 90, 95, 97, 103 or 105; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 11, 20, 30, 36, 42, 54, 58, 62, 64, 74, 78, 90, 95, 97, 103 or 105, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In other illustrative examples, the presence of an herpes virus infection or related condition is determined by detecting an increase in the level or functional activity of at least one HVI marker polynucleotide selected from (a) a polynucleotide comprising a nucleotide sequence that shares at least 50% (and at least 51% to at least 99% and all integer percentages in between) sequence identity with the sequence set forth in any one of SEQ ID NO: 1, 2, 4, 8, 12, 13, 15, 17, 21, 23, 26, 27, 31, 39, 43, 45, 47, 49, 51, 55, 59, 67, 69, 71, 75, 76, 79, 81, 85, 87, 91, 98, 99 109, 111 or 113, or a complement thereof; (b) a polynucleotide comprising a nucleotide sequence that encodes a polypeptide comprising the amino acid sequence set forth in any one of SEQ ID NO: 3, 5, 9, 14, 16, 18, 22, 28, 32, 40, 44, 46, 48, 50, 52, 56, 60, 68, 70, 72, 80, 82, 86, 88, 92, 110, 112 or 114; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 3, 5, 9, 14, 16, 18, 22, 28, 32, 40, 44, 46, 48, 50, 52, 56, 60, 68, 70, 72, 80, 82, 86, 88, 92, 110, 112 or 114 wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In some embodiments, the method further comprises diagnosing the absence of an herpes virus infection or related condition when the measured level or functional activity of the or each expression product is the same as or similar to the measured level or functional activity of the or each corresponding expression product. In these embodiments, the measured level or functional activity of an individual expression product varies from the measured level or functional activity of an individual corresponding expression product by no more than about 20%, 18%, 16%, 14%, 12%, 10%, 9%, 8%, 7%, 6%, 5%, 4%, 3%, 2%, 1% or 0.1%, which is hereafter referred to as "normal expression.".

In some embodiments, the methods comprise measuring the level or functional activity of individual expression products of at least about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77 or 78 HVI marker polynucleotides. For example, the methods may comprise measuring the level or functional activity of an HVI marker polynucleotide either alone or in combination with as much as 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2 or 1 other HVI marker polynucleotide(s). In another example, the methods may comprise measuring the level or functional activity of an HVI marker polypeptide either alone or in combination with as much as 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2 or 1 other HVI marker polypeptides(s). In illustrative examples of this type, the methods comprise measuring the level or functional activity of individual expression products of at least 1, 2, 3, 4, 5, 6, 7, 8, 9, 10, 11, 12, 13, 14, 15, 16 or 17 HVI marker genes that have a very high correlation ($p<0.00001$) with the presence or risk of an herpes virus infection or related condition (hereafter referred to as "level one correlation HVI marker genes"), representative examples of which include, but are not limited to, (a) a polynucleotide comprising a nucleotide sequence that shares at least 50% (and at least 51% to at least 99% and all integer percentages in between) sequence identity with the sequence set forth in any one of SEQ ID NO: 1, 2, 4, 6, 7, 8, 10, 12, 13, 15, 17, 19, 21, 23, 24, 25 or 26, or a complement thereof, (b) a polynucleotide comprising a nucleotide sequence that encodes a polypeptide comprising the amino acid sequence set forth in any one of SEQ ID NO: 3, 5, 9, 11, 14, 16, 18, 20 or 22; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 3, 5, 9, 11, 14, 16, 18, 20 or 22 wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In other illustrative examples, the methods comprise measuring the level or functional activity of individual expression products of at least 1, 2, 3, 4, 5, 6, 7, 8, 9, 10, 11, 12, 13, 14, 15, 16, 17, 18, 19 20 or 21 HVI marker genes that have a high correlation ($p<0.0001$) with the presence or risk of an herpes virus infection or related condition (hereafter referred to as "level two correlation HVI marker genes"), representative examples of which include, but are not limited to, (a) a polynucleotide comprising a nucleotide sequence that shares at least 50% (and at least 51% to at least 99% and all integer percentages in between) sequence identity with the sequence set forth in any one of SEQ ID NO: 27, 29, 31, 33, 34, 35, 37, 38, 39, 41, 43, 45, 47, 49, 51, 53, 55, 57, 59, 61 or 63, or a complement thereof; (b) a polynucleotide comprising a nucleotide sequence that encodes a polypeptide comprising the amino acid sequence set forth in any one of SEQ ID NO: 28, 30, 32, 36, 40, 42, 44, 46, 48, 50, 52, 56, 58, 60, 62 or 64; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 28, 30, 32, 36, 40, 42, 44, 46, 48, 50, 52, 56, 58, 60, 62 or 64, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In still other illustrative examples, the methods comprise measuring the level or functional activity of individual expression products of at least 1, 2, 3, 4, 5, 6, 7, 8, 9, 10, 11, 12, 13, 14 or 15 HVI marker genes that have a medium correlation (p<0.0003) with the presence or risk of an herpes virus infection or related condition (hereafter referred to as "level three correlation HVI marker genes"), representative examples of which include, but are not limited to, (a) a polynucleotide comprising a nucleotide sequence that shares at least 50% (and at least 51% to at least 99% and all integer percentages in between) sequence identity with the sequence set forth in any one of SEQ ID NO: 65, 66, 67, 69, 71, 73, 75, 76, 77, 79, 81, 83, 84, 85 or 87, or a complement thereof, (b) a polynucleotide comprising a nucleotide sequence that encodes a polypeptide comprising the amino acid sequence set forth in any one of SEQ ID NO: 68, 70, 72, 74, 78, 80, 82, 86 or 88; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 68, 70, 72, 74, 78, 80, 82, 86 or 88, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In still other illustrative examples, the methods comprise measuring the level or functional activity of individual expression products of at least 1, 2, 3, 4, 5, 6, 7, 8, 9, 10, 11, 12, 13, 14, 15, 16 or 17 herpes virus infection marker genes that have a moderate correlation (p<0.06) with the presence or risk of an herpes virus infection or related condition (hereafter referred to as "level four correlation HVI marker genes"), representative examples of which include, but are not limited to, (a) a polynucleotide comprising a nucleotide sequence that shares at least 50% (and at least 51% to at least 99% and all integer percentages in between) sequence identity with the sequence set forth in any one of SEQ ID NO: 89, 91, 93, 94, 96, 98, 99, 100, 101, 102, 104, 106, 107, 108, 109, 111 or 113, or a complement thereof; (b) a polynucleotide comprising a nucleotide sequence that encodes a polypeptide comprising the amino acid sequence set forth in any one of SEQ ID NO: 90, 92, 95, 97, 103, 105, 110, 112 or 114; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 90, 92, 95, 97, 103, 105, 110, 112 or 114 wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In some embodiments, the methods comprise measuring the level or functional activity of an expression product of at least 1 level one correlation HVI marker gene. In other embodiments, the methods comprise measuring the level or functional activity of an expression product of at least 2 level one correlation HVI marker genes. In still other embodiments, the methods comprise measuring the level or functional activity of an expression product of at least 1 level one correlation HVI marker gene and the level or functional activity of an expression product of at least 1 level two HVI marker gene. In still other embodiments, the methods comprise measuring the level or functional activity of an expression product of at least 2 level one correlation HVI marker genes and the level or functional activity of an expression product of at least 1 level two correlation HVI marker gene. In still other embodiments, the methods comprise measuring the level or functional activity of an expression product of at least 1 level one correlation HVI marker gene and the level or functional activity of an expression product of at least 2 level two correlation HVI marker genes.

In some embodiments, the methods comprise measuring the level or functional activity of an expression product of at least 1 level one correlation HVI marker gene and the level or functional activity of an expression product of at least 1 level three correlation HVI marker gene. In other embodiments, the methods comprise measuring the level or functional activity of an expression product of at least 2 level one correlation HVI marker genes and the level or functional activity of an expression product of at least 1 level three correlation HVI marker gene. In still other embodiments, the methods comprise measuring the level or functional activity of an expression product of at least 1 level one correlation HVI marker gene and the level or functional activity of an expression product of at least 2 level three correlation HVI marker genes. In still other embodiments, the methods comprise measuring the level or functional activity of an expression product of at least 1 level one correlation HVI marker gene and the level or functional activity of an expression product of at least 3 level three correlation HVI marker genes.

In some embodiments, the methods comprise measuring the level or functional activity of an expression product of at least 1 level one correlation HVI marker gene and the level or functional activity of an expression product of at least 1 level four correlation HVI marker gene. In other embodiments, the methods comprise measuring the level or functional activity of an expression product of at least 2 level one correlation HVI marker genes and the level or functional activity of an expression product of at least 1 level four correlation HVI marker gene. In still other embodiments, the methods comprise measuring the level or functional activity of an expression product of at least 1 level one correlation HVI marker gene and the level or functional activity of an expression product of at least 2 level four correlation HVI marker gene. In still other embodiments, the methods comprise measuring the level or functional activity of an expression product of at least 1 level one correlation HVI marker gene and the level or functional activity of an expression product of at least 3 level four correlation HVI marker genes. In still other embodiments, the methods comprise measuring the level or functional activity of an expression product of at least 1 level one correlation HVI marker gene and the level or functional activity of an expression product of at least 4 level four correlation HVI marker genes.

In some embodiments, the methods comprise measuring the level or functional activity of an expression product of at least 1 level two correlation HVI marker gene. In other embodiments, the methods comprise measuring the level or functional activity of an expression product of at least 2 level two correlation HVI marker genes. In still other embodiments, the methods comprise measuring the level or functional activity of an expression product of at least 1 level two correlation HVI marker gene and the level or functional activity of an expression product of at least 1 level three correlation HVI marker gene. In other embodiments, the methods comprise measuring the level or functional activity of an expression product of at least 2 level two correlation HVI marker genes and the level or functional activity of an expression product of at least 1 level three correlation HVI marker gene. In still other embodiments, the methods comprise measuring the level or functional activity of an expression product of at least 1 level two correlation HVI marker gene and the level or functional activity of an expression product of at least 2 level three correlation HVI marker genes. In still other embodiments, the methods comprise measuring the level or functional activity of an expression product of at least 1 level two correlation HVI marker gene and the level or functional activity of an expression product of at least 3 level three correlation HVI marker genes. In still other embodiments, the methods comprise measuring the level or functional activity of an expression product of at least 1 level two correlation HVI marker gene and the level or functional activity of an expression product of at least 4 level three correlation HVI marker genes.

In some embodiments, the methods comprise measuring the level or functional activity of an expression product of at least 1 level two correlation HVI marker gene and the level or functional activity of an expression product of at least 1 level four correlation HVI marker gene. In other embodiments, the methods comprise measuring the level or functional activity of an expression product of at least 2 level two correlation HVI marker genes and the level or functional activity of an expression product of at least 1 level four correlation HVI marker gene. In still other embodiments, the methods comprise measuring the level or functional activity of an expression product of at least 1 level two correlation HVI marker gene and the level or functional activity of an expression product of at least 2 level four correlation HVI marker genes. In still other embodiments, the methods comprise measuring the level or functional activity of an expression product of at least 1 level two correlation HVI marker gene and the level or functional activity of an expression product of at least 3 level four correlation HVI marker genes. In still other embodiments, the methods comprise measuring the level or functional activity of an expression product of at least 1 level two correlation HVI marker gene and the level or functional activity of an expression product of at least 4 level four correlation HVI marker genes. In still other embodiments, the methods comprise measuring the level or functional activity of an expression product of at least 1 level two correlation HVI marker gene and the level or functional activity of an expression product of at least 5 level four correlation HVI marker genes.

In some embodiments, the methods comprise measuring the level or functional activity of an expression product of at least 1 level two correlation HVI marker gene. In other embodiments, the methods comprise measuring the level or functional activity of an expression product of at least 2 level two correlation HVI marker gene. In still other embodiments, the methods comprise measuring the level or functional activity of an expression product of at least 1 level two correlation HVI marker gene and the level or functional activity of an expression product of at least 1 level five correlation HVI marker gene. In other embodiments, the methods comprise measuring the level or functional activity of an expression product of at least 2 level two correlation HVI marker genes and the level or functional activity of an expression product of at least 1 level five correlation HVI marker gene. In still other embodiments, the methods comprise measuring the level or functional activity of an expression product of at least 1 level two correlation HVI marker gene and the level or functional activity of an expression product of at least 2 level five correlation HVI marker genes. In still other embodiments, the methods comprise measuring the level or functional activity of an expression product of at least 1 level two correlation HVI marker gene and the level or functional activity of an expression product of at least 3 level five correlation HVI marker genes. In still other embodiments, the methods comprise measuring the level or functional activity of an expression product of at least 1 level two correlation HVI marker gene and the level or functional activity of an expression product of at least 4 level five correlation HVI marker genes.

In still other embodiments, the methods comprise measuring the level or functional activity of an expression product of at least 1 level two correlation HVI marker gene and the level or functional activity of an expression product of at least 5 level five correlation HVI marker genes.

In some embodiments, the methods comprise measuring the level or functional activity of an expression product of at least 1 level three correlation HVI marker gene. In other embodiments, the methods comprise measuring the level or functional activity of an expression product of at least 2 level three correlation HVI marker genes. In still other embodiments, the methods comprise measuring the level or functional activity of an expression product of at least 1 level three correlation HVI marker gene and the level or functional activity of an expression product of at least 1 level four correlation HVI marker gene. In other embodiments, the methods comprise measuring the level or functional activity of an expression product of at least 2 level three correlation HVI marker genes and the level or functional activity of an expression product of at least 1 level four correlation HVI marker gene. In still other embodiments, the methods comprise measuring the level or functional activity of an expression product of at least 1 level three correlation HVI marker gene and the level or functional activity of an expression product of at least 2 level four correlation HVI marker genes. In still other embodiments, the methods comprise measuring the level or functional activity of an expression product of at least 1 level three correlation HVI marker gene and the level or functional activity of an expression product of at least 3 level four correlation HVI marker genes. In still other embodiments, the methods comprise measuring the level or functional activity of an expression product of at least 1 level three correlation HVI marker gene and the level or functional activity of an expression product of at least 4 level four correlation HVI marker genes. In still other embodiments, the methods comprise measuring the level or functional activity of an expression product of at least 1 level three correlation HVI marker gene and the level or functional activity of an expression product of at least 5 level four correlation HVI marker genes.

In some embodiments, the methods comprise measuring the level or functional activity of an expression product of at least 1 level four correlation HVI marker gene. In other embodiments, the methods comprise measuring the level or functional activity of an expression product of at least 2 level four correlation HVI marker genes. In other embodiments, the methods comprise measuring the level or functional activity of an expression product of at least 3 level four correlation HVI marker genes. In still other embodiments, the methods comprise measuring the level or functional activity of an expression product of at least 3 level four correlation HVI marker genes. In still other embodiments, the methods comprise measuring the level or functional activity of an expression product of at least 4 level four correlation HVI marker genes. In still other embodiments, the methods comprise measuring the level or functional activity of an expression product of at least 5 level four correlation HVI marker genes. In still other embodiments, the methods comprise measuring the level or functional activity of an expression product of at least 6 level four correlation HVI marker genes.

Advantageously, the biological sample comprises blood, especially peripheral blood, which suitably includes leukocytes. Suitably, the expression product is selected from a RNA molecule or a polypeptide. In some embodiments, the expression product is the same as the corresponding expression product. In other embodiments, the expression product is a variant (e.g., an allelic variant) of the corresponding expression product.

In certain embodiments, the expression product or corresponding expression product is a target RNA (e.g., mRNA) or a DNA copy of the target RNA whose level is measured using at least one nucleic acid probe that hybridizes under at least low, medium, or high stringency conditions to the target RNA or to the DNA copy, wherein the nucleic acid probe comprises at least 15 contiguous nucleotides of an HVI marker polynucleotide. In these embodiments, the measured level or abundance of the target RNA or its DNA copy is normalized to the level or abundance of a reference RNA or a DNA copy of the reference RNA that is present in the same sample. Suitably, the nucleic acid probe is immobilized on a solid or semi-solid support. In illustrative examples of this type, the nucleic acid probe forms part of a spatial array of nucleic acid probes. In some embodiments, the level of nucleic acid probe that is bound to the target RNA or to the DNA copy is measured by hybridization (e.g., using a nucleic acid array). In other embodiments, the level of nucleic acid probe that is bound to the target RNA or to the DNA copy is measured by nucleic acid amplification (e.g., using a polymerase chain reaction (PCR)). In still other embodiments, the level of nucleic acid probe that is bound to the target RNA or to the DNA copy is measured by nuclease protection assay.

In other embodiments, the expression product or corresponding expression product is a target polypeptide whose level is measured using at least one antigen-binding molecule that is immuno-interactive with the target polypeptide. In these embodiments, the measured level of the target polypeptide is normalized to the level of a reference polypeptide that is present in the same sample. Suitably, the antigen-binding molecule is immobilized on a solid or semi-solid support. In illustrative examples of this type, the antigen-binding molecule forms part of a spatial array of antigen-binding molecule. In some embodiments, the level of antigen-binding molecule that is bound to the target polypeptide is measured by immunoassay (e.g., using an ELISA).

In still other embodiments, the expression product or corresponding expression product is a target polypeptide whose level is measured using at least one substrate for the target polypeptide with which it reacts to produce a reaction product. In these embodiments, the measured functional activity of the target polypeptide is normalized to the functional activity of a reference polypeptide that is present in the same sample.

In some embodiments, a system is used to perform the diagnostic methods as broadly described above, which suitably comprises at least one end station coupled to a base station. The base station is suitably caused (a) to receive subject data from the end station via a communications network, wherein the subject data represents parameter values corresponding to the measured or normalized level or functional activity of at least one expression product in the biological sample, and (b) to compare the subject data with predetermined data representing the measured or normalized level or functional activity of at least one corresponding expression product in the reference sample to thereby determine any difference in the level or functional activity of the expression product in the biological sample as compared to the level or functional activity of the corresponding expression product in the reference sample. Desirably, the base station is further caused to provide a diagnosis for the presence, absence or degree of Herpes virus infection-related conditions. In these embodiments, the base station may be further caused to transfer an indication of the diagnosis to the end station via the communications network.

In another aspect, the invention contemplates use of the methods broadly described above in the monitoring, treatment and management of animals with conditions that can lead to Herpes virus infection, illustrative examples of which include immunosuppression, new-borns, stress or intensive athletic training regimens. In these embodiments, the diagnostic methods of the invention are typically used at a frequency that is effective to monitor the early development of an herpes virus infection or related condition to thereby enable early therapeutic intervention and treatment of that condition.

In another aspect, the present invention provides methods for treating, preventing or inhibiting the development of an herpes virus infection or related condition in a subject. These methods generally comprise detecting aberrant expression of at least one HVI marker gene in the subject, and administering to the subject an effective amount of an agent that treats or ameliorates the symptoms or reverses or inhibits the development of the infection or related condition in the subject. Representative examples of such treatments or agents include but are not limited to, antibiotics, steroids and anti-inflammatory drugs, intravenous fluids, vasoactives, palliative support for damaged or distressed organs (e.g. oxygen for respiratory distress, fluids for hypovolemia) and close monitoring of vital organs.

In another aspect, the present invention provides isolated polynucleotides, referred to herein as "HVI marker polynucleotides," which are generally selected from: (a) a polynucleotide comprising a nucleotide sequence that shares at least 50% (and at least 51% to at least 99% and all integer percentages in between) sequence identity with the sequence set forth in any one of SEQ ID NO: 1, 12, 23, 24, 25, 26, 33, 34, 37, 38, 65, 66, 75, 76, 83, 84, 93, 98, 99, 100, 101, 106, 107 or 108, or a complement thereof; (b) a polynucleotide comprising a portion of the sequence set forth in any one of SEQ ID NO: 1, 12, 23, 24, 25, 26, 33, 34, 37, 38, 65, 66, 75, 76, 83, 84, 93, 98, 99, 100, 101, 106, 107 or 108, or a complement thereof, wherein the portion comprises at least 15 contiguous nucleotides of that sequence or complement; (c) a polynucleotide that hybridizes to the sequence of (a) or (b) or a complement thereof, under at least low, medium or high stringency conditions; and (d) a polynucleotide comprising a portion of any one of SEQ ID NO: 1, 12, 23, 24, 25, 26, 33, 34, 37, 38, 65, 66, 75, 76, 83, 84, 93, 98, 99, 100, 101, 106, 107 or 108, or a complement thereof, wherein the portion comprises at least 15 contiguous nucleotides of that sequence or complement and hybridizes to a sequence of (a), (b) or (c), or a complement thereof, under at least low, medium or high stringency conditions.

In yet another aspect, the present invention provides a nucleic acid construct comprising a polynucleotide as broadly described above in operable connection with a regulatory element, which is operable in a host cell. In certain embodiments, the construct is in the form of a vector, especially an expression vector.

In still another aspect, the present invention provides isolated host cells containing a nucleic acid construct or vector as broadly described above. In certain advantageous embodiments, the host cells are selected from bacterial cells, yeast cells and insect cells.

In still another aspect, the present invention provides probes for interrogating nucleic acid for the presence of a polynucleotide as broadly described above. These probes generally comprise a nucleotide sequence that hybridizes under at least low stringency conditions to a polynucleotide as broadly described above. In some embodiments, the probes consist essentially of a nucleic acid sequence which corresponds or is complementary to at least a portion of a nucleotide sequence encoding the amino acid sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114 wherein the portion is at least 15 nucleotides in length. In other embodiments, the probes comprise a nucleotide sequence which is capable of hybridizing to at least a portion of a nucleotide sequence encoding the amino acid sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114 under at least low, medium or high stringency conditions, wherein the portion is at least 15 nucleotides in length. In still other embodiment, the probes comprise a nucleotide sequence that is capable of hybridizing to at least a portion of any one of SEQ ID NO: 1, 2, 4, 6, 7, 8, 10, 12, 13, 15, 17, 19, 21, 23, 24, 25, 26, 27, 29, 31, 33, 34, 35, 37, 38, 39, 41, 43, 45, 47, 49, 51, 53, 55, 57, 59, 61, 63, 65, 66, 67, 69, 71, 73, 75, 76, 77, 79, 81, 83, 84, 85, 87, 89, 91, 93, 94, 96, 98, 99, 100, 101, 102, 104, 106, 107, 108, 109, 111 or 113 under at least low, medium or high stringency conditions, wherein the portion is at least 15 nucleotides in length. Representative probes for detecting the HVI marker polynucleotides according to the resent invention are set forth in SEQ ID NO: 145-2150 (see Table 2).

In a related aspect, the invention provides a solid or semi-solid support comprising at least one nucleic acid probe as broadly described above immobilized thereon. In some embodiments, the solid or semi-solid support comprises a spatial array of nucleic acid probes immobilized thereon.

In a further aspect, the present invention provides isolated polypeptides, referred to herein as "HVI marker polypeptides," which are generally selected from: (i) a polypeptide comprising an amino acid sequence that shares at least 50% (and at least 51% to at least 99% and all integer percentages in between) sequence similarity with a polypeptide expression product of an HVI marker gene as broadly described above, for example, especially an HVI marker gene that comprises a nucleotide sequence that shares at least 50% (and at least 51% to at least 99% and all integer percentages in between) sequence identity with the sequence set forth in any one of SEQ ID NO: 1, 2, 4, 6, 7, 8, 10, 12, 13, 15, 17, 19, 21, 23, 24, 25, 26, 27, 29, 31, 33, 34, 35, 37, 38, 39, 41, 43, 45, 47, 49, 51, 53, 55, 57, 59, 61, 63, 65, 66, 67, 69, 71, 73, 75, 76, 77, 79, 81, 83, 84, 85, 87, 89, 91, 93, 94, 96, 98, 99, 100, 101, 102, 104, 106, 107, 108, 109, 111 or 113; (ii) a portion of the polypeptide according to (i) wherein the portion comprises at least 5 contiguous amino acid residues of that polypeptide; (iii) a polypeptide comprising an amino acid sequence that shares at least 30% similarity (and at least 31% to at least 99% and all integer percentages in between) with at least 15 contiguous amino acid residues of the polypeptide according to (i); and (iv) a polypeptide comprising an amino acid sequence that is immuno-interactive with an antigen-binding molecule that is immuno-interactive with a sequence of (i), (ii) or (iii).

Still a further aspect of the present invention provides an antigen-binding molecule that is immuno-interactive with an HVI marker polypeptide as broadly described above.

In a related aspect, the invention provides a solid or semi-solid support comprising at least one antigen-binding molecule as broadly described above immobilized thereon. In some embodiments, the solid or semi-solid support comprises a spatial array of antigen-binding molecules immobilized thereon.

Still another aspect of the invention provides the use of one or more HVI marker polynucleotides as broadly described above, or the use of one or more probes as broadly described above, or the use of one or more HVI marker polypeptides as broadly described above, or the use of one or more antigen-binding molecules as broadly described above, in the manufacture of a kit for diagnosing the presence of an Herpes virus infection-related condition in a subject.

The aspects of the invention are directed to the use of the diagnostic methods as broadly described above, or one or more HVI marker polynucleotides as broadly described above, or the use of one or more probes as broadly described above, or the use of one or more HVI marker polypeptides as broadly described above, or the use of one or more antigen-binding molecules as broadly described above, for diagnosing an Herpes virus infection-related condition animals (vertebrates), mammals, non-human mammals, animals, such as horses involved in load bearing or athletic activities (e.g., races) and pets (e.g., dogs and cats).

The aspects of the invention are directed to animals (vertebrates), mammals, non-human mammals, animals, such as horses involved in load bearing or athletic activities (e.g., races) and pets (e.g., dogs and cats).

DETAILED DESCRIPTION OF THE INVENTION

1. Definitions

Figure 1:
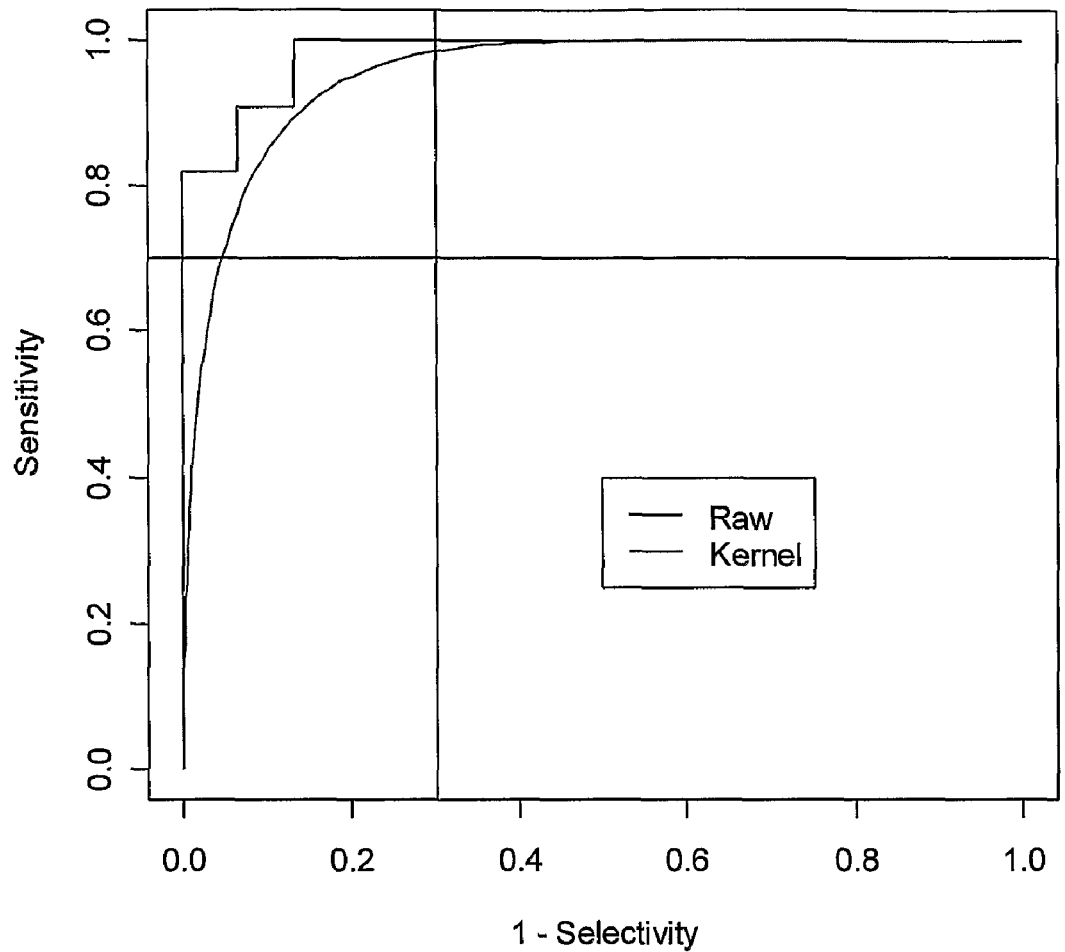
FIG. 1 is a graphical representation of a Receiver Operator Curve for inoculated animals in Group 1, comparing gene expression at Days 2, 4 and 6 with the other days. The sensitivity and specificity of a test using the gene expression signature is excellent with an area under the curve in excess of 0.9.

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, preferred methods and materials are described. For the purposes of the present invention, the following terms are defined below.

The articles "a" and "an" are used herein to refer to one or to more than one (i.e. to at least one) of the grammatical object of the article. By way of example, "an element" means one element or more than one element.

The term "aberrant expression," as used herein to describe the expression of an HVI marker gene, refers to the overexpression or underexpression of an HVI marker gene relative to the level of expression of the HVI marker gene or variant thereof in cells obtained from a healthy subject or from a subject that is not infected with the herpes virus, and/or to a higher or lower level of an HVI marker gene product (e.g., transcript or polypeptide) in a tissue sample or body fluid obtained from a healthy subject or from a subject without the herpes virus. In particular, an HVI marker gene is aberrantly expressed if its level of expression is higher by at least about 10%, 20%, 30%, 40%, 50%, 60%, 70%, 80% or 90%, or even an at least about 100%, 200%, 300%, 400%, 500%, 600%, 700%, 800%, 900% or 1000%, or lower by at least about 10%, 20%, 30% 40%, 50%, 60%, 70%, 80%, 90%, 92%, 94%, 96%, 97%, 98% or 99%, or even an at least about 99.5%, 99.9%, 99.95%, 99.99%, 99.995% or 99.999% than its level of expression in a cell, tissue or body fluid sample obtained from a healthy subject or from a subject without the herpes virus.

The term "aberrant expression," as used herein to describe the expression of an HVI marker polynucleotide, refers to the over-expression or under-expression of an HVI marker polynucleotide relative to the level of expression of the HVI marker polynucleotide or variant thereof in cells obtained from a healthy subject or from a subject lacking herpes virus infection related disease (e.g., lacking active herpes virus infection), and/or to a higher or lower level of an HVI marker polynucleotide product (e.g., transcript or polypeptide) in a tissue sample or body fluid obtained from a healthy subject or from a subject lacking herpes virus infection disease. In particular, an HVI marker polynucleotide is aberrantly expressed if the level of expression of the HVI marker polynucleotide is higher by at least about 10%, 20%, 30%, 40%, 50%, 60%, 70%, 80% or 90%, or even an at least about 100%, 200%, 300%, 400%, 500%, 600%, 700%, 800%, 900% or 1000%, or lower by at least about 10%, 20%, 30% 40%, 50%, 60%, 70%, 80%, 90%, 92%, 94%, 96%, 97%, 98% or 99%, or even an at least about 99.5%, 99.9%, 99.95%, 99.99%, 99.995% or 99.999% than the level of expression of the HVI marker polynucleotide by cells obtained from a healthy subject or from a subject lacking herpes virus infection disease, and/or relative to the level of expression of the HVI marker polynucleotide in a tissue sample or body fluid obtained from a healthy subject or from a subject lacking herpes virus infection disease. In accordance with the present invention, aberrant gene expression in cells of the immune system, and particularly in circulating leukocytes, is deduced from two consecutive steps: (1) discovery of aberrantly expressed genes for diagnosis, prognosis and condition assessment; and (2) clinical validation of aberrantly expressed genes.

Aberrant gene expression in discovery is defined by those genes that are significantly up or down regulated (p<0.06) when comparing groups of cell or tissue samples (e.g., cells of the immune system such as but not limited to white blood cells) following (a) normalization to invariant genes, whose expression remains constant under normal and diseased conditions, and (b) the use of a statistical method that protects against false positives (e.g., Holm and FDR adjustment) to account for false positive discovery inherent in multivariate data such as microarray data. Those skilled in the art of gene expression data analysis will recognize that other forms of data normalization may be adopted without materially altering the nature of the invention (for example MAS5, Robust multi chip averaging, GC Robust multi chip averaging or the Li Wong algorithm). For diagnosis, the cell or tissue samples are typically obtained from a group representing true negative cell or tissue samples for the condition of interest and from a group representing true positive cell or tissue samples for that condition. Generally, all other parameters or variables in the groups need to be controlled, such as age, geographical location, sex, athletic fitness and other normal biological variation, suitably by use of the same animal and induction of the condition of interest in that animal. Those skilled in the art of experimental design will recognize that alternative approaches to controlling for other parameters and variables may be adopted, without materially affecting the nature of the invention. Such approaches include, but are not limited to, randomization, blocking and the use of covariates in analysis. For prognosis, the cell or tissue samples are typically obtained from a group representing true negative cell or tissue samples for the condition of interest and from the same group that subsequently (over time) represents true positive cell or tissue samples for that condition. Generally, all other parameters or variables in the groups need to be controlled, such as age, geographical location, sex, athletic fitness and other normal biological variation, typically by use of the same animals, induction of the condition of interest in those animals and samples taken from the same animal over time. For assessment, the cell or tissue samples are generally obtained from a group representing one end of a spectrum of measurable clinical parameters relating to the condition of interest and from groups representing various points along that spectrum of measurable clinical parameters. Similarly, all other parameters or variables in the groups generally need to be controlled, such as age, geographical location, sex, athletic fitness and other normal biological variation, suitably by use of the same animal and induction of the condition of interest in that animal.

Aberrant gene expression in clinical validation is defined by those genes from the discovery list that can be demonstrated to be significantly up or down regulated following normalization to invariant genes in the cells or tissues whose gene expression is the subject of the analysis and for the condition of interest in clinical cell or tissue samples used in the discovery process such that the aberrantly expressed genes can correctly diagnose or assess a condition at least 75% of the time. Generally, receiver operator curves (ROC) are a useful measure of such diagnostic performance. Those skilled in the art of gene expression data analyzes will recognize that other methods of normalization (for example MAS5, Robust multi chip averaging, GC Robust multi chip averaging or the Li Wong algorithm) may be substituted for invariant gene normalization without materially affecting the nature of the invention. Furthermore, those skilled in the art of gene expression data analysis will recognize that many methods may be used to determine which genes are "significantly up or down regulated".

By "about" is meant a quantity, level, value, number, frequency, percentage, dimension, size, amount, weight or length that varies by as much as 30, 25, 20, 25, 10, 9, 8, 7, 6, 5, 4, 3, 2 or 1% to a reference quantity, level, value, number, frequency, percentage, dimension, size, amount, weight or length.

The term "active infection" is used herein in its broadest sense and includes the invasion, establishment and/or multiplication of a virus in a host, which is typically associated with one or more pathological symptoms that may or may not be clinically apparent. Active infections include localized, subclinical or temporary infections. A local infection may persist and spread by extension to become an acute, subacute or chronic clinical infection or disease state. A local infection may also become systemic when a virus gains access to the lymphatic or vascular system. Typically, "active infection" refers to an infectious state in which a host's immune system is activated against an infectious agent.

The term "amplicon" refers to a target sequence for amplification, and/or the amplification products of a target sequence for amplification. In certain other embodiments an "amplicon" may include the sequence of probes or primers used in amplification.

By "antigen-binding molecule" is meant a molecule that has binding affinity for a target antigen. It will be understood that this term extends to immunoglobulins, immunoglobulin fragments and non-immunoglobulin derived protein frameworks that exhibit antigen-binding activity.

As used herein, the term "binds specifically," "specifically immuno-interactive" and the like when referring to an antigen-binding molecule refers to a binding reaction which is determinative of the presence of an antigen in the presence of a heterogeneous population of proteins and other biologics. Thus, under designated immunoassay conditions, the specified antigen-binding molecules bind to a particular antigen and do not bind in a significant amount to other proteins or antigens present in the sample. Specific binding to an antigen under such conditions may require an antigen-binding molecule that is selected for its specificity for a particular antigen. For example, antigen-binding molecules can be raised to a selected protein antigen, which bind to that antigen but not to other proteins present in a sample. A variety of immunoassay formats may be used to select antigen-binding molecules specifically immuno-interactive with a particular protein. For example, solid-phase ELISA immunoassays are routinely used to select monoclonal antibodies specifically immuno-interactive with a protein. See Harlow and Lane (1988) Antibodies, A Laboratory Manual, Cold Spring Harbor Publications, New York, for a description of immunoassay formats and conditions that can be used to determine specific immunoreactivity.

By "biologically active portion" is meant a portion of a full-length parent peptide or polypeptide which portion retains an activity of the parent molecule. As used herein, the term "biologically active portion" includes deletion mutants and peptides, for example of at least about 8, 9, 10, 11, 12, 13, 14, 15, 16, 17, 18, 19, 20, 21, 22, 23, 24, 25, 30, 40, 50, 60, 70, 80, 90, 100, 120, 150, 300, 400, 500, 600, 700, 800, 900, 1000 contiguous amino acids, which comprise an activity of a parent molecule. Portions of this type may be obtained through the application of standard recombinant nucleic acid techniques or synthesized using conventional liquid or solid phase synthesis techniques. For example, reference may be made to solution synthesis or solid phase synthesis as described, for example, in Chapter 9 entitled "*Peptide Synthesis*" by Atherton and Shephard which is included in a publication entitled "*Synthetic Vaccines*" edited by Nicholson and published by Blackwell Scientific Publications. Alternatively, peptides can be produced by digestion of a peptide or polypeptide of the invention with proteinases such as endoLys-C, endoArg-C, endoGlu-C and *staphylococcus* V8-protease. The digested fragments can be purified by, for example, high performance liquid chromatographic (HPLC) techniques. Recombinant nucleic acid techniques can also be used to produce such portions.

The term "biological sample" as used herein refers to a sample that may be extracted, untreated, treated, diluted or concentrated from an animal. The biological sample may include a biological fluid such as whole blood, serum, plasma, saliva, urine, sweat, ascitic fluid, peritoneal fluid, synovial fluid, amniotic fluid, cerebrospinal fluid, tissue biopsy, and the like. In certain embodiments, the biological sample is blood, especially peripheral blood.

As used herein, the term "cis-acting sequence", "cis-acting element" or "cis-regulatory region" or "regulatory region" or similar term shall be taken to mean any sequence of nucleotides, which when positioned appropriately relative to an expressible genetic sequence, is capable of regulating, at least in part, the expression of the genetic sequence. Those skilled in the art will be aware that a cis-regulatory region may be capable of activating, silencing, enhancing, repressing or otherwise altering the level of expression and/or cell-type-specificity and/or developmental specificity of a gene sequence at the transcriptional or post-transcriptional level. In certain embodiments of the present invention, the cis-acting sequence is an activator sequence that enhances or stimulates the expression of an expressible genetic sequence.

Throughout this specification, unless the context requires otherwise, the words "comprise," "comprises" and "comprising" will be understood to mean the inclusion of a stated step or element or group of steps or elements but not the exclusion of any other step or element or group of steps or elements.

By "corresponds to" or "corresponding to" is meant a polynucleotide (a) having a nucleotide sequence that is substantially identical or complementary to all or a portion of a reference polynucleotide sequence or (b) encoding an amino acid sequence identical to an amino acid sequence in a peptide or protein. This phrase also includes within its scope a peptide or polypeptide having an amino acid sequence that is substantially identical to a sequence of amino acids in a reference peptide or protein.

By "effective amount", in the context of treating or preventing a condition, is meant the administration of that amount of active to an individual in need of such treatment or prophylaxis, either in a single dose or as part of a series, that is effective for the prevention of incurring a symptom, holding in check such symptoms, and/or treating existing symptoms, of that condition. The effective amount will vary depending upon the health and physical condition of the individual to be treated, the taxonomic group of individual to be treated, the formulation of the composition, the assessment of the medical situation, and other relevant factors. It is expected that the amount will fall in a relatively broad range that can be determined through routine trials.

The terms "expression" or "gene expression" refer to either production of RNA message or translation of RNA message into proteins or polypeptides. Detection of either types of gene expression in use of any of the methods described herein are part of the invention.

By "expression vector" is meant any autonomous genetic element capable of directing the transcription of a polynucleotide contained within the vector and suitably the synthesis of a peptide or polypeptide encoded by the polynucleotide. Such expression vectors are known to practitioners in the art.

The term "gene" as used herein refers to any and all discrete coding regions of the cell's genome, as well as associated non-coding and regulatory regions. The gene is also intended to mean the open reading frame encoding specific polypeptides, introns, and adjacent 5' and 3' non-coding nucleotide sequences involved in the regulation of expression. In this regard, the gene may further comprise control signals such as promoters, enhancers, termination and/or polyadenylation signals that are naturally associated with a given gene, or heterologous control signals. The DNA sequences may be cDNA or genomic DNA or a fragment thereof. The gene may be introduced into an appropriate vector for extrachromosomal maintenance or for integration into the host.

By "high density polynucleotide arrays" and the like is meant those arrays that contain at least 400 different features per cm$^2$.

The phrase "high discrimination hybridization conditions" refers to hybridization conditions in which single base mismatch may be determined.

"Hybridization" is used herein to denote the pairing of complementary nucleotide sequences to produce a DNA-DNA hybrid or a DNA-RNA hybrid. Complementary base sequences are those sequences that are related by the base-pairing rules. In DNA, A pairs with T and C pairs with G. In RNA U pairs with A and C pairs with G. In this regard, the terms "match" and "mismatch" as used herein refer to the hybridization potential of paired nucleotides in complementary nucleic acid strands. Matched nucleotides hybridize efficiently, such as the classical A-T and G-C base pair mentioned above. Mismatches are other combinations of nucleotides that do not hybridize efficiently.

The phrase "hybridizing specifically to" and the like refer to the binding, duplexing, or hybridizing of a molecule only to a particular nucleotide sequence under stringent conditions when that sequence is present in a complex mixture (e.g., total cellular) DNA or RNA.

Reference herein to "immuno-interactive" includes reference to any interaction, reaction, or other form of association between molecules and in particular where one of the molecules is, or mimics, a component of the immune system.

"Immune function" or "immunoreactivity" refers to the ability of the immune system to respond to foreign antigen as measured by standard assays well known in the art.

By "isolated" is meant material that is substantially or essentially free from components that normally accompany it in its native state. For example, an "isolated polynucleotide", as used herein, refers to a polynucleotide, isolated from the sequences which flank it in a naturally-occurring state, e.g., a DNA fragment which has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment, and from association with other components of the cell. Without limitation, an isolated polynucleotide, peptide, or polypeptide can refer to a native sequence that is isolated by purification or to a sequence that is produced by recombinant or synthetic means.

By "marker gene" is meant a gene that imparts a distinct phenotype to cells expressing the marker gene and thus allows such transformed cells to be distinguished from cells that do not have the marker. A selectable marker gene confers a trait for which one can 'select' based on resistance to a selective agent (e.g., a herbicide, antibiotic, radiation, heat, or other treatment damaging to untransformed cells). A screenable marker gene (or reporter gene) confers a trait that one can identify through observation or testing, i.e., by 'screening' (e.g. β-glucuronidase, luciferase, or other enzyme activity not present in untransformed cells).

As used herein, a "naturally-occurring" nucleic acid molecule refers to a RNA or DNA molecule having a nucleotide sequence that occurs in nature. For example a naturally-occurring nucleic acid molecule can encode a protein that occurs in nature.

By "obtained from" is meant that a sample such as, for example, a cell extract or nucleic acid or polypeptide extract is isolated from, or derived from, a particular source. For instance, the extract may be isolated directly from biological fluid or tissue of the subject.

The term "oligonucleotide" as used herein refers to a polymer composed of a multiplicity of nucleotide residues (deoxyribonucleotides or ribonucleotides, or related structural variants or synthetic analogues thereof, including nucleotides with modified or substituted sugar groups and the like) linked via phosphodiester bonds (or related structural variants or synthetic analogues thereof). Thus, while the term "oligonucleotide" typically refers to a nucleotide polymer in which the nucleotide residues and linkages between them are naturally-occurring, it will be understood that the term also includes within its scope various analogues including, but not restricted to, peptide nucleic acids (PNAs), phosphorothioate, phosphorodithioate, phosphoroselenoate, phosphorodiselenoate, phosphoroanilothioate, phosphoraniladate, phosphoroamidate, methyl phosphonates, 2-O-methyl ribonucleic acids, and the like. The exact size of the molecule can vary depending on the particular application. Oligonucleotides are a polynucleotide subset with 200 bases or fewer in length. Preferably, oligonucleotides are 10 to 60 bases in length and most preferably 12, 13, 14, 15, 16, 17, 18, 19, or 20 to 40 bases in length. Oligonucleotides are usually single stranded, e.g., for probes; although oligonucleotides may be double stranded, e.g., for use in the construction of a variant nucleic acid sequence. Oligonucleotides of the invention can be either sense or antisense oligonucleotides.

The term "oligonucleotide array" refers to a substrate having oligonucleotide probes with different known sequences deposited at discrete known locations associated with its surface. For example, the substrate can be in the form of a two dimensional substrate as described in U.S. Pat. No. 5,424,186. Such substrate may be used to synthesize two-dimensional spatially addressed oligonucleotide (matrix) arrays. Alternatively, the substrate may be characterized in that it forms a tubular array in which a two dimensional planar sheet is rolled into a three-dimensional tubular configuration. The substrate may also be in the form of a microsphere or bead connected to the surface of an optic fiber as, for example, disclosed by Chee et al. in WO 00/39587. Oligonucleotide arrays have at least two different features and a density of at least 400 features per cm$^2$. In certain embodiments, the arrays can have a density of about 500, at least one thousand, at least 10 thousand, at least 100 thousand, at least one million or at least 10 million features per cm$^2$. For example, the substrate may be silicon or glass and can have the thickness of a glass microscope slide or a glass cover slip, or may be composed of other synthetic polymers. Substrates that are transparent to light are useful when the method of performing an assay on the substrate involves optical detection. The term also refers to a probe array and the substrate to which it is attached that form part of a wafer.

The term "operably connected" or "operably linked" as used herein means placing a structural gene under the regulatory control of a promoter, which then controls the transcription and optionally translation of the gene. In the construction of heterologous promoter/structural gene combinations, it is generally preferred to position the genetic sequence or promoter at a distance from the gene transcription start site that is approximately the same as the distance between that genetic sequence or promoter and the gene it controls in its natural setting; i.e., the gene from which the genetic sequence or promoter is derived. As is known in the art, some variation in this distance can be accommodated without loss of function. Similarly, the preferred positioning of a regulatory sequence element with respect to a heterologous gene to be placed under its control is defined by the positioning of the element in its natural setting; i.e., the genes from which it is derived.

The term "pathogen" is used herein in its broadest sense to refer to an organism or infectious agent whose infection of cells of viable animal tissue elicits a disease response.

The term "polynucleotide" or "nucleic acid" as used herein designates mRNA, RNA, cRNA, cDNA or DNA. The term typically refers to polymeric form of nucleotides of at least 10 bases in length, either ribonucleotides or deoxynucleotides or a modified form of either type of nucleotide. The term includes single and double stranded forms of DNA.

The terms "polynucleotide variant" and "variant" refer to polynucleotides displaying substantial sequence identity with a reference polynucleotide sequence or polynucleotides that hybridize with a reference sequence under stringent conditions that are defined hereinafter. These terms also encompass polynucleotides in which one or more nucleotides have been added or deleted, or replaced with different nucleotides. In this regard, it is well understood in the art that certain alterations inclusive of mutations, additions, deletions and substitutions can be made to a reference polynucleotide whereby the altered polynucleotide retains a biological function or activity of the reference polynucleotide. The terms "polynucleotide variant" and "variant" also include naturally-occurring allelic variants.

"Polypeptide", "peptide" and "protein" are used interchangeably herein to refer to a polymer of amino acid residues and to variants and synthetic analogues of the same. Thus, these terms apply to amino acid polymers in which one or more amino acid residues is a synthetic non-naturally-occurring amino acid, such as a chemical analogue of a corresponding naturally-occurring amino acid, as well as to naturally-occurring amino acid polymers.

The term "polypeptide variant" refers to polypeptides which are distinguished from a reference polypeptide by the addition, deletion or substitution of at least one amino acid residue. In certain embodiments, one or more amino acid residues of a reference polypeptide are replaced by different amino acids. It is well understood in the art that some amino acids may be changed to others with broadly similar properties without changing the nature of the activity of the polypeptide (conservative substitutions) as described hereinafter.

By "primer" is meant an oligonucleotide which, when paired with a strand of DNA, is capable of initiating the synthesis of a primer extension product in the presence of a suitable polymerizing agent. The primer is preferably single-stranded for maximum efficiency in amplification but can alternatively be double-stranded. A primer must be sufficiently long to prime the synthesis of extension products in the presence of the polymerization agent. The length of the primer depends on many factors, including application, temperature to be employed, template reaction conditions, other reagents, and source of primers. For example, depending on the complexity of the target sequence, the primer may be at least about 5, 6, 7, 8, 9, 10, 11, 12, 13, 14, 15, 16, 17, 18, 19, 20, 21, 22, 23, 24, 25, 26, 27, 28, 29, 30, 35, 40, 50, 75, 100, 150, 200, 300, 400, 500, to one base shorter in length than the template sequence at the 3' end of the primer to allow extension of a nucleic acid chain, though the 5' end of the primer may extend in length beyond the 3' end of the template sequence. In certain embodiments, primers can be large polynucleotides, such as from about 35 nucleotides to several kilobases or more. Primers can be selected to be "substantially complementary" to the sequence on the template to which it is designed to hybridize and serve as a site for the initiation of synthesis. By "substantially complementary", it is meant that the primer is sufficiently complementary to hybridize with a target polynucleotide. Desirably, the primer contains no mismatches with the template to which it is designed to hybridize but this is not essential. For example, non-complementary nucleotide residues can be attached to the 5' end of the primer, with the remainder of the primer sequence being complementary to the template. Alternatively, non-complementary nucleotide residues or a stretch of non-complementary nucleotide residues can be interspersed into a primer, provided that the primer sequence has sufficient complementarity with the sequence of the template to hybridize therewith and thereby form a template for synthesis of the extension product of the primer.

"Probe" refers to a molecule that binds to a specific sequence or sub-sequence or other moiety of another molecule. Unless otherwise indicated, the term "probe" typically refers to a polynucleotide probe that binds to another polynucleotide, often called the "target polynucleotide", through complementary base pairing. Probes can bind target polynucleotides lacking complete sequence complementarity with the probe, depending on the stringency of the hybridization conditions. Probes can be labeled directly or indirectly and include primers within their scope.

The term "recombinant polynucleotide" as used herein refers to a polynucleotide formed in vitro by the manipulation of nucleic acid into a form not normally found in nature. For example, the recombinant polynucleotide may be in the form of an expression vector. Generally, such expression vectors include transcriptional and translational regulatory nucleic acid operably linked to the nucleotide sequence.

By "recombinant polypeptide" is meant a polypeptide made using recombinant techniques, i.e., through the expression of a recombinant or synthetic polynucleotide.

By "regulatory element" or "regulatory sequence" is meant nucleic acid sequences (e.g., DNA) necessary for expression of an operably linked coding sequence in a particular host cell. The regulatory sequences that are suitable for prokaryotic cells for example, include a promoter, and optionally a cis-acting sequence such as an operator sequence and a ribosome binding site. Control sequences that are suitable for eukaryotic cells include promoters, polyadenylation signals, transcriptional enhancers, translational enhancers, leader or trailing sequences that modulate mRNA stability, as well as targeting sequences that target a product encoded by a transcribed polynucleotide to an intracellular compartment within a cell or to the extracellular environment.

The term "sequence identity" as used herein refers to the extent that sequences are identical on a nucleotide-by-nucleotide basis or an amino acid-by-amino acid basis over a window of comparison. Thus, a "percentage of sequence identity" is calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. For the purposes of the present invention, "sequence identity" will be understood to mean the "match percentage" calculated by the DNASIS computer program (Version 2.5 for windows; available from Hitachi Software engineering Co., Ltd., South San Francisco, Calif., USA) using standard defaults as used in the reference manual accompanying the software.

"Similarity" refers to the percentage number of amino acids that are identical or constitute conservative substitutions as defined in Table 3. Similarity may be determined using sequence comparison programs such as GAP (Deveraux et al. 1984, Nucleic Acids Research 12, 387-395). In this way, sequences of a similar or substantially different length to those cited herein might be compared by insertion of gaps into the alignment, such gaps being determined, for example, by the comparison algorithm used by GAP.

Terms used to describe sequence relationships between two or more polynucleotides or polypeptides include "reference sequence", "comparison window", "sequence identity", "percentage of sequence identity" and "substantial identity". A "reference sequence" is at least 12 but frequently 15 to 18 and often at least 25 monomer units, inclusive of nucleotides and amino acid residues, in length. Because two polynucleotides may each comprise (1) a sequence (i.e., only a portion of the complete polynucleotide sequence) that is similar between the two polynucleotides, and (2) a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window" refers to a conceptual segment of at least 6 contiguous positions, usually about 50 to about 100, more usually about 100 to about 150 in which a sequence is compared to a reference sequence of the same number of contiguous positions after the two sequences are optimally aligned. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., 1997, Nucl. Acids Res. 25:3389. A detailed discussion of sequence analysis can be found in Unit 19.3 of Ausubel et al., "Current Protocols in Molecular Biology", John Wiley & Sons Inc, 1994-1998, Chapter 15.

The terms "subject" or "individual" or "patient", used interchangeably herein, refer to any subject, particularly a vertebrate subject, and even more particularly a mammalian subject, for whom therapy or prophylaxis is desired. Suitable vertebrate animals that fall within the scope of the invention include, but are not restricted to, primates, avians, livestock animals (e.g., sheep, cows, horses, donkeys, pigs), laboratory test animals (e.g., rabbits, mice, rats, guinea pigs, hamsters), companion animals (e.g., cats, dogs) and captive wild animals (e.g., foxes, deer, dingoes). A preferred subject is an animal, especially an equine animal, in need of treatment or prophylaxis of a herpes virus infection or its associated symptoms. However, it will be understood that the aforementioned terms do not imply that symptoms are present.

The phrase "substantially similar affinities" refers herein to target sequences having similar strengths of detectable hybridization to their complementary or substantially complementary oligonucleotide probes under a chosen set of stringent conditions.

The term "template" as used herein refers to a nucleic acid that is used in the creation of a complementary nucleic acid strand to the "template" strand. The template may be either RNA and/or DNA, and the complementary strand may also be RNA and/or DNA. In certain embodiments, the complementary strand may comprise all or part of the complementary sequence to the "template," and/or may include mutations so that it is not an exact, complementary strand to the "template". Strands that are not exactly complementary to the template strand may hybridize specifically to the template strand in detection assays described here, as well as other assays known in the art, and such complementary strands that can be used in detection assays are part of the invention.

The term "transformation" means alteration of the genotype of an organism, for example a bacterium, yeast, mammal, avian, reptile, fish or plant, by the introduction of a foreign or endogenous nucleic acid.

The term "treat" is meant to include both therapeutic and prophylactic treatment.

By "vector" is meant a polynucleotide molecule, suitably a DNA molecule derived, for example, from a plasmid, bacteriophage, yeast, virus, mammal, avian, reptile or fish into which a polynucleotide can be inserted or cloned. A vector preferably contains one or more unique restriction sites and can be capable of autonomous replication in a defined host cell including a target cell or tissue or a progenitor cell or tissue thereof, or be integrable with the genome of the defined host such that the cloned sequence is reproducible. Accordingly, the vector can be an autonomously replicating vector, i.e., a vector that exists as an extrachromosomal entity, the replication of which is independent of chromosomal replication, e.g., a linear or closed circular plasmid, an extrachromosomal element, a minichromosome, or an artificial chromosome. The vector can contain any means for assuring self-replication. Alternatively, the vector can be one which, when introduced into the host cell, is integrated into the genome and replicated together with the chromosome(s) into which it has been integrated. A vector system can comprise a single vector or plasmid, two or more vectors or plasmids, which together contain the total DNA to be introduced into the genome of the host cell, or a transposon. The choice of the vector will typically depend on the compatibility of the vector with the host cell into which the vector is to be introduced. The vector can also include a selection marker such as an antibiotic resistance gene that can be used for selection of suitable transformants. Examples of such resistance genes are known to those of skill in the art.

The terms "wild-type" and "normal" are used interchangeably to refer to the phenotype that is characteristic of most of the members of the species occurring naturally and contrast for example with the phenotype of a mutant.

2. Abbreviations

The following abbreviations are used throughout the application:
nt=nucleotide
nts=nucleotides
aa=amino acid(s)
kb=kilobase(s) or kilobase pair(s)
kDa=kilodalton(s)
d=day
h=hour
s=seconds 3. Markers of Herpes Virus Infection and Uses Therefor The present invention concerns the early detection, diagnosis, monitoring, or prognosis of herpes virus infections, especially EHV infections, or conditions related thereto. Surrogate markers of herpes virus infection in the form of RNA molecules of specified sequences, or polypeptides expressed from these RNA molecules in cells, especially in blood cells, and more especially in peripheral blood cells, of subjects with herpes virus infection, are disclosed. These markers are indicators of herpes virus infection and, when differentially expressed, as compared to their expression in normal subjects or in subjects lacking herpes virus-related disease, are diagnostic for the presence or risk of development of herpes virus infection, especially active herpes virus infection, in tested subjects. Such markers provide considerable advantages over the prior art in this field. In certain advantageous embodiments where peripheral blood is used for the analysis, it is possible to diagnose herpes virus infection before serum antibodies are detected.

It will be apparent that the nucleic acid sequences disclosed herein will find utility in a variety of applications in herpes virus detection, diagnosis, prognosis and treatment. Examples of such applications within the scope of the present disclosure comprise amplification of HVI markers using specific primers, detection of HVI markers by hybridization with oligonucleotide probes, incorporation of isolated nucleic acids into vectors, expression of vector-incorporated nucleic acids as RNA and protein, and development of immunological reagents corresponding to marker encoded products.

The identified HVI markers may in turn be used to design specific oligonucleotide probes and primers. Such probes and primers may be of any length that would specifically hybridize to the identified marker gene sequences and may be at least about 10, 11, 12, 13, 14, 15, 16, 17, 18, 19, 20, 21, 22, 23, 24, 25, 26, 27, 28, 29, 30, 35, 40, 50, 75, 100, 150, 200, 300, 400, 500 nucleotides in length and in the case of probes, up to the full length of the sequences of the marker genes identified herein. Probes may also include additional sequence at their 5' and/or 3' ends so that they extent beyond the target sequence with which they hybridize.

When used in combination with nucleic acid amplification procedures, these probes and primers enable the rapid analysis of biological samples (e.g., peripheral blood samples) for detecting marker genes or for detecting or quantifying marker gene transcripts. Such procedures include any method or technique known in the art or described herein for duplicating or increasing the number of copies or amount of a target nucleic acid or its complement.

The identified markers may also be used to identify and isolate full-length gene sequences, including regulatory elements for gene expression, from genomic DNA libraries, which are suitably but not exclusively of equine origin. The cDNA sequences identified in the present disclosure may be used as hybridization probes to screen genomic DNA libraries by conventional techniques. Once partial genomic clones have been identified, full-length genes may be isolated by "chromosomal walking" (also called "overlap hybridization") using, for example, the method disclosed by Chinault & Carbon (1979, Gene 5: 111-126). Once a partial genomic clone has been isolated using a cDNA hybridization probe, non-repetitive segments at or near the ends of the partial genomic clone may be used as hybridization probes in further genomic library screening, ultimately allowing isolation of entire gene sequences for the HVI markers of interest. It will be recognized that full-length genes may be obtained using the full-length or partial cDNA sequences or short expressed sequence tags (ESTs) described in this disclosure using standard techniques as disclosed for example by Sambrook, et al. (MOLECULAR CLONING. A LABORATORY MANUAL (Cold Spring Harbor Press, 1989) and Ausubel et al., (CURRENT PROTOCOLS IN MOLECULAR BIOLOGY, John Wiley & Sons, Inc. 1994). In addition, the disclosed sequences may be used to identify and isolate full-length cDNA sequences using standard techniques as disclosed, for example, in the above-referenced texts. Sequences identified and isolated by such means may be useful in the detection of HVI marker polynucleotides using the detection methods described herein, and are part of the invention.

One of ordinary skill in the art could select segments from the identified marker genes for use in the different detection, diagnostic, or prognostic methods, vector constructs, antigen-binding molecule production, kit, and/or any of the embodiments described herein as part of the present invention. Marker gene sequences that are desirable for use in the invention are those set fort in SEQ ID NO: 1, 2, 4, 6, 7, 8, 10, 12, 13, 15, 17, 19, 21, 23, 24, 25, 26, 27, 29, 31, 33, 34, 35, 37, 38, 39, 41, 43, 45, 47, 49, 51, 53, 55, 57, 59, 61, 63, 65, 66, 67, 69, 71, 73, 75, 76, 77, 79, 81, 83, 84, 85, 87, 89, 91, 93, 94, 96, 98, 99, 100, 101, 102, 104, 106, 107, 108, 109, 111 or 113.

3.1 Nucleic Acid Molecules of the Invention

As described in the Examples and in Table 1, the present disclosure provides 63 markers of herpes virus (i.e., 63 HVI marker genes), identified by GeneChip™ analysis of blood obtained from normal horses and from horses with clinical evidence of EHV. Of the 63 marker genes, 44 have full-length or substantially full-length coding sequences and the remaining 21 have partial sequence information at one or both of their 5' and 3' ends. The identified HVI marker genes include 21 previously uncharacterized equine genes.

In accordance with the present invention, the sequences of isolated nucleic acids disclosed herein find utility inter alia as hybridization probes or amplification primers. These nucleic acids may be used, for example, in diagnostic evaluation of biological samples or employed to clone full-length cDNAs or genomic clones corresponding thereto. In certain embodiments, these probes and primers represent oligonucleotides, which are of sufficient length to provide specific hybridization to a RNA or DNA sample extracted from the biological sample. The sequences typically will be about 10-20 nucleotides, but may be longer. Longer sequences, e.g., of about 30, 40, 50, 100, 500 and even up to full-length, are desirable for certain embodiments.

Nucleic acid molecules having contiguous stretches of about 10, 15, 17, 20, 30, 40, 50, 60, 75 or 100 or 500 nucleotides of a sequence set forth in any one of SEQ ID NO: 1, 2, 4, 6, 7, 8, 10, 12, 13, 15, 17, 19, 21, 23, 24, 25, 26, 27, 29, 31, 33, 34, 35, 37, 38, 39, 41, 43, 45, 47, 49, 51, 53, 55, 57, 59, 61, 63, 65, 66, 67, 69, 71, 73, 75, 76, 77, 79, 81, 83, 84, 85, 87, 89, 91, 93, 94, 96, 98, 99, 100, 101, 102, 104, 106, 107, 108, 109, 111 or 113 are contemplated. Molecules that are complementary to the above mentioned sequences and that bind to these sequences under high stringency conditions are also contemplated. These probes are useful in a variety of hybridization embodiments, such as Southern and northern blotting. In some cases, it is contemplated that probes may be used that hybridize to multiple target sequences without compromising their ability to effectively diagnose herpes virus infection. In general, it is contemplated that the hybridization probes described herein are useful both as reagents in solution hybridization, as in PCR, for detection of expression of corresponding genes, as well as in embodiments employing a solid phase.

Various probes and primers may be designed around the disclosed nucleotide sequences. For example, in certain embodiments, the sequences used to design probes and primers may include repetitive stretches of adenine nucleotides (poly-A tails) normally attached at the ends of the RNA for the identified marker genes. In other embodiments, probes and primers may be specifically designed to not include these or other segments from the identified marker genes, as one of ordinary skilled in the art may deem certain segments more suitable for use in the detection methods disclosed. In any event, the choice of primer or probe sequences for a selected application is within the realm of the ordinary skilled practitioner. Illustrative probe sequences for detection of HVI marker polynucleotides are presented in Table 2.

Primers may be provided in double-stranded or single-stranded form, although the single-stranded form is desirable. Probes, while perhaps capable of priming, are designed to bind to a target DNA or RNA and need not be used in an amplification process. In certain embodiments, the probes or primers are labeled with radioactive species ($^{32}$P, $^{14}$C, $^{35}$S, $^{3}$H, or other label), with a fluorophore (e.g., rhodamine, fluorescein) or with a chemillumiscent label (e.g., luciferase).

The present invention provides substantially full-length cDNA sequences as well as EST and partial cDNA sequences that are useful as markers of EHV. It will be understood, however, that the present disclosure is not limited to these disclosed sequences and is intended particularly to encompass at least isolated nucleic acids that are hybridizable to nucleic acids comprising the disclosed sequences or that are variants of these nucleic acids. For example, a nucleic acid of partial sequence may be used to identify a structurally-related gene or the full-length genomic or cDNA clone from which it is derived. Methods for generating cDNA and genomic libraries which may be used as a target for the above-described probes are known in the art (see, for example, Sambrook et al., 1989, supra and Ausubel et al., 1994, supra). All such nucleic acids as well as the specific nucleic acid molecules disclosed herein are collectively referred to as "herpes virus infection marker polynucleotides" or "HVI marker polynucleotides." Additionally, the present invention includes within its scope isolated or purified expression products of HVI marker polynucleotides (i.e., RNA transcripts and polypeptides).

Accordingly, the present invention encompasses isolated or substantially purified nucleic acid or protein compositions. An "isolated" or "purified" nucleic acid molecule or protein, or biologically active portion thereof, is substantially or essentially free from components that normally accompany or interact with the nucleic acid molecule or protein as found in its naturally occurring environment. Thus, an isolated or purified polynucleotide or polypeptide is substantially free of other cellular material, or culture medium when produced by recombinant techniques, or substantially free of chemical precursors or other chemicals when chemically synthesized. Suitably, an "isolated" polynucleotide is free of sequences (especially protein encoding sequences) that naturally flank the polynucleotide (i.e., sequences located at the 5' and 3' ends of the polynucleotide) in the genomic DNA of the organism from which the polynucleotide was derived. For example, in various embodiments, an isolated HVI marker polynucleotide can contain less than about 5 kb, 4 kb, 3 kb, 2 kb, 1 kb, 0.5 kb, or 0.1 kb of nucleotide sequences that naturally flank the polynucleotide in genomic DNA of the cell from which the polynucleotide was derived. A polypeptide that is substantially free of cellular material includes preparations of protein having less than about 30%, 20%, 10%, 5%, (by dry weight) of contaminating protein. When the protein of the invention or biologically active portion thereof is recombinantly produced, culture medium suitably represents less than about 30%, 20%, 10%, or 5% (by dry weight) of chemical precursors or non-protein-of-interest chemicals.

The present invention also encompasses portions of the full-length or substantially full-length nucleotide sequences of the HVI marker polynucleotides or their transcripts or DNA copies of these transcripts. Portions of an HVI marker nucleotide sequence may encode polypeptide portions or segments that retain the biological activity of the native polypeptide. Alternatively, portions of an HVI marker nucleotide sequence that are useful as hybridization probes generally do not encode amino acid sequences retaining such biological activity. Thus, portions of an HVI marker nucleotide sequence may range from at least about 15, 16, 17, 18, 19, 20, 21, 22, 23, 24, 25, 26, 27, 28, 29, 30, 40, 50, 60, 80, 90, 100 nucleotides, or almost up to the full-length nucleotide sequence encoding the HVI marker polypeptides of the invention.

A portion of an HVI marker nucleotide sequence that encodes a biologically active portion of an HVI marker polypeptide of the invention may encode at least about 5, 6, 7, 8, 9, 10, 11, 12, 13, 14, 15, 16, 17, 18, 19, 20, 21, 22, 23, 24, 25, 30, 40, 50, 60, 70, 80, 90, 100, 120, 150, 300, 400, 500, 600, 700, 800, 900 or 1000, or even at least about 2000, 3000, 4000 or 5000 contiguous amino acid residues, or almost up to the total number of amino acids present in a full-length HVI marker polypeptide. Portions of an HVI marker nucleotide sequence that are useful as hybridization probes or PCR primers generally need not encode a biologically active portion of an HVI marker polypeptide.

Thus, a portion of an HVI marker nucleotide sequence may encode a biologically active portion of an HVI marker polypeptide, or it may be a fragment that can be used as a hybridization probe or PCR primer using standard methods known in the art. A biologically active portion of an HVI marker polypeptide can be prepared by isolating a portion of one of the HVI marker nucleotide sequences of the invention, expressing the encoded portion of the HVI marker polypeptide (e.g., by recombinant expression in vitro), and assessing the activity of the encoded portion of the HVI marker polypeptide. Nucleic acid molecules that are portions of an HVI marker nucleotide sequence comprise at least about 15, 16, 17, 18, 19, 20, 25, 30, 50, 75, 100, 150, 200, 250, 300, 350, 400, 450, 500, 550, 600, or 650 nucleotides, or almost up to the number of nucleotides present in a full-length HVI marker nucleotide sequence.

The invention also contemplates variants of the HVI marker nucleotide sequences. Nucleic acid variants can be naturally-occurring, such as allelic variants (same locus), homologues (different locus), and orthologues (different organism) or can be non naturally-occurring. Naturally occurring variants such as these can be identified with the use of well-known molecular biology techniques, as, for example, with polymerase chain reaction (PCR) and hybridization techniques as known in the art. Non-naturally occurring variants can be made by mutagenesis techniques, including those applied to polynucleotides, cells, or organisms. The variants can contain nucleotide substitutions, deletions, inversions and insertions. Variation can occur in either or both the coding and non-coding regions. The variations can produce both conservative and non-conservative amino acid substitutions (as compared in the encoded product). For nucleotide sequences, conservative variants include those sequences that, because of the degeneracy of the genetic code, encode the amino acid sequence of one of the EHV marker polypeptides of the invention. Variant nucleotide sequences also include synthetically derived nucleotide sequences, such as those generated, for example, by using site-directed mutagenesis but which still encode an HVI marker polypeptide of the invention. Generally, variants of a particular nucleotide sequence of the invention will have at least about 30%, 40% 50%, 55%, 60%, 65%, 70%, generally at least about 75%, 80%, 85%, desirably about 90% to 95% or more, and more suitably about 98% or more sequence identity to that particular nucleotide sequence as determined by sequence alignment programs described elsewhere herein using default parameters.

The HVI marker nucleotide sequences of the invention can be used to isolate corresponding sequences and alleles from other organisms, particularly other mammals, especially other equine species. Methods are readily available in the art for the hybridization of nucleic acid sequences. Coding sequences from other organisms may be isolated according to well known techniques based on their sequence identity with the coding sequences set forth herein. In these techniques all or part of the known coding sequence is used as a probe which selectively hybridizes to other HVI marker coding sequences present in a population of cloned genomic DNA fragments or cDNA fragments (i.e., genomic or cDNA libraries) from a chosen organism. Accordingly, the present invention also contemplates polynucleotides that hybridize to the HVI marker polynucleotide nucleotide sequences, or to their complements, under stringency conditions described below. As used herein, the term "hybridizes under low stringency, medium stringency, high stringency, or very high stringency conditions" describes conditions for hybridization and washing. Guidance for performing hybridization reactions can be found in Ausubel et al., (1998, supra), Sections 6.3.1-6.3.6. Aqueous and non-aqueous methods are described in that reference and either can be used. Reference herein to low stringency conditions include and encompass from at least about 1% v/v to at least about 15% v/v formamide and from at least about 1 M to at least about 2 M salt for hybridization at 42° C., and at least about 1 M to at least about 2 M salt for washing at 42° C. Low stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at room temperature. One embodiment of low stringency conditions includes hybridization in 6× sodium chloride/sodium citrate (SSC) at about 45° C., followed by two washes in 0.2×SSC, 0.1% SDS at least at 50° C. (the temperature of the washes can be increased to 55° C. for low stringency conditions). Medium stringency conditions include and encompass from at least about 16% v/v to at least about 30% v/v formamide and from at least about 0.5 M to at least about 0.9 M salt for hybridization at 42° C., and at least about 0.1 M to at least about 0.2 M salt for washing at 55° C. Medium stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at 60-65° C. One embodiment of medium stringency conditions includes hybridizing in 6×SSC at about 45° C., followed by one or more washes in 0.2×SSC, 0.1% SDS at 60° C. High stringency conditions include and encompass from at least about 31% v/v to at least about 50% v/v formamide and from about 0.01 M to about 0.15 M salt for hybridization at 42° C., and about 0.01 M to about 0.02 M salt for washing at 55° C. High stringency conditions also may include 1% BSA, 1 mM EDTA, 0.5M NaHPO$_4$ (pH 7.2), 7% SDS for hybridization at 65° C., and (i) 0.2×SSC, 0.1% SDS; or (ii) 0.5% BSA, 1 mM EDTA, 40 mM NaHPO$_4$ (pH 7.2), 1% SDS for washing at a temperature in excess of 65° C. One embodiment of high stringency conditions includes hybridizing in 6×SSC at about 45° C., followed by one or more washes in 0.2×SSC, 0.1% SDS at 65° C.

In certain embodiments, an HVI marker polypeptide is encoded by a polynucleotide that hybridizes to a disclosed nucleotide sequence under very high stringency conditions. One embodiment of very high stringency conditions includes hybridizing 0.5 M sodium phosphate, 7% SDS at 65° C., followed by one or more washes at 0.2×SSC, 1% SDS at 65° C.

Other stringency conditions are well known in the art and a skilled addressee will recognize that various factors can be manipulated to optimize the specificity of the hybridization. Optimization of the stringency of the final washes can serve to ensure a high degree of hybridization. For detailed examples, see Ausubel et al., supra at pages 2.10.1 to 2.10.16 and Sambrook et al. (1989, supra) at sections 1.101 to 1.104.

While stringent washes are typically carried out at temperatures from about 42° C. to 68° C., one skilled in the art will appreciate that other temperatures may be suitable for stringent conditions. Maximum hybridization rate typically occurs at about 20° C. to 25° C. below the $T_m$ for formation of a DNA-DNA hybrid. It is well known in the art that the $T_m$ is the melting temperature, or temperature at which two complementary polynucleotide sequences dissociate. Methods for estimating $T_m$ are well known in the art (see Ausubel et al., supra at page 2.10.8). In general, the $T_m$ of a perfectly matched duplex of DNA may be predicted as an approximation by the formula:

$$T_m = 81.5 + 16.6(\log_{10} M) + 0.41(\% \ G+C) - 0.63(\% \ \text{formamide}) - (600/\text{length})$$

wherein: M is the concentration of Na$^+$, preferably in the range of 0.01 molar to 0.4 molar; % G+C is the sum of guanosine and cytosine bases as a percentage of the total number of bases, within the range between 30% and 75% G+C; % formamide is the percent formamide concentration by volume; length is the number of base pairs in the DNA duplex. The $T_m$ of a duplex DNA decreases by approximately 1° C. with every increase of 1% in the number of randomly mismatched base pairs. Washing is generally carried out at $T_m - 15°$ C. for high stringency, or $T_m - 30°$ C. for moderate stringency.

In one example of a hybridization procedure, a membrane (e.g., a nitrocellulose membrane or a nylon membrane) containing immobilized DNA is hybridized overnight at 42° C. in a hybridization buffer (50% deionised formamide, 5×SSC, 5×Denhardt's solution (0.1% ficoll, 0.1% polyvinylpyrollidone and 0.1% bovine serum albumin), 0.1% SDS and 200 mg/mL denatured salmon sperm DNA) containing labeled probe. The membrane is then subjected to two sequential medium stringency washes (i.e., 2×SSC, 0.1% SDS for 15 min at 45° C., followed by 2×SSC, 0.1% SDS for 15 min at 50° C.), followed by two sequential higher stringency washes (i.e., 0.2×SSC, 0.1% SDS for 12 min at 55° C. followed by 0.2×SSC and 0.1% SDS solution for 12 min at 65-68° C.

3.2 Polypeptides of the Invention

The present invention also contemplates full-length polypeptides encoded by the HVI marker polynucleotides of the invention as well as the biologically active portions of those polypeptides, which are referred to collectively herein as "herpes virus infection marker polynucleotide" or "HVI marker polypeptides". Biologically active portions of full-length HVI marker polypeptides include portions with immuno-interactive activity of at least about 6, 8, 10, 12, 14, 16, 18, 20, 25, 30, 40, 50, 60 amino acid residues in length. For example, immuno-interactive fragments contemplated by the present invention are at least 6 and desirably at least 8 amino acid residues in length, which can elicit an immune response in an animal for the production of antigen-binding molecules that are immuno-interactive with an HVI marker polypeptide of the invention. Such antigen-binding molecules can be used to screen other mammals, especially equine mammals, for structurally and/or functionally related HVI marker polypeptides. Typically, portions of a full-length HVI marker polypeptide may participate in an interaction, for example, an intramolecular or an inter-molecular interaction. An inter-molecular interaction can be a specific binding interaction or an enzymatic interaction (e.g., the interaction can be transient and a covalent bond is formed or broken). Biologically active portions of a full-length HVI marker polypeptide include peptides comprising amino acid sequences sufficiently similar to or derived from the amino acid sequences of a (putative) full-length HVI marker polypeptide, for example, the amino acid sequences shown in SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114, which include less amino acids than a full-length HVI marker polypeptide, and exhibit at least one activity of that polypeptide. Typically, biologically active portions comprise a domain or motif with at least one activity of a full-length HVI marker polypeptide. A biologically active portion of a full-length HVI marker polypeptide can be a polypeptide which is, for example, 5, 6, 7, 8, 9, 10, 11, 12, 13, 14, 15, 16, 17, 18, 19, 20, 21, 22, 23, 24, 25, 30, 40, 50, 60, 70, 80, 90, 100, 120, 150, 300, 400, 500, 600, 700, 800, 900 or 1000, or even at least about 2000, 3000, 4000 or 5000, or more amino acid residues in length. Suitably, the portion is a "biologically-active portion" having no less than about 1%, 10%, 25% 50% of the activity of the full-length polypeptide from which it is derived.

The present invention also contemplates variant HVI marker polypeptides. "Variant" polypeptides include proteins derived from the native protein by deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Variant proteins encompassed by the present invention are biologically active, that is, they continue to possess the desired biological activity of the native protein. Such variants may result from, for example, genetic polymorphism or from human manipulation. Biologically active variants of a native HVI marker protein of the invention will have at least 40%, 50%, 60%, 70%, generally at least 75%, 80%, 85%, preferably about 90% to 95% or more, and more preferably about 98% or more sequence similarity with the amino acid sequence for the native protein as determined by sequence alignment programs described elsewhere herein using default parameters. A biologically active variant of a protein of the invention may differ from that protein generally by as much 1000, 500, 400, 300, 200, 100, 50 or 20 amino acid residues or suitably by as few as 1-15 amino acid residues, as few as 1-10, such as 6-10, as few as 5, as few as 4, 3, 2, or even 1 amino acid residue.

AN HVI marker polypeptide of the invention may be altered in various ways including amino acid substitutions, deletions, truncations, and insertions. Methods for such manipulations are generally known in the art. For example, amino acid sequence variants of an HVI marker protein can be prepared by mutations in the DNA. Methods for mutagenesis and nucleotide sequence alterations are well known in the art. See, for example, Kunkel (1985, *Proc. Natl. Acad. Sci. USA* 82:488-492), Kunkel et al. (1987, *Methods in Enzymol.* 154:367-382), U.S. Pat. No. 4,873,192, Watson, J. D. et al. ("Molecular Biology of the Gene", Fourth Edition, Benjamin/Cummings, Menlo Park, Calif., 1987) and the references cited therein. Guidance as to appropriate amino acid substitutions that do not affect biological activity of the protein of interest may be found in the model of Dayhoff et al. (1978, Atlas of Protein Sequence and Structure, Natl. Biomed. Res. Found., Washington, D.C.). Methods for screening gene products of combinatorial libraries made by point mutations or truncation, and for screening cDNA libraries for gene products having a selected property are known in the art. Such methods are adaptable for rapid screening of the gene libraries generated by combinatorial mutagenesis of HVI marker polypeptides. Recursive ensemble mutagenesis (REM), a technique which enhances the frequency of functional mutants in the libraries, can be used in combination with the screening assays to identify HVI marker polypeptide variants (Arkin and Yourvan (1992) *Proc. Natl. Acad. Sci. USA* 89:7811-7815; Delgrave et al. (1993) *Protein Engineering* 6:327-331). Conservative substitutions, such as exchanging one amino acid with another having similar properties, may be desirable as discussed in more detail below.

Variant HVI marker polypeptides may contain conservative amino acid substitutions at various locations along their sequence, as compared to the parent HVI marker amino acid sequence. A "conservative amino acid substitution" is one in which the amino acid residue is replaced with an amino acid residue having a similar side chain. Families of amino acid residues having similar side chains have been defined in the art, which can be generally sub-classified as follows:

Acidic: The residue has a negative charge due to loss of H ion at physiological pH and the residue is attracted by aqueous solution so as to seek the surface positions in the conformation of a peptide in which it is contained when the peptide is in aqueous medium at physiological pH. Amino acids having an acidic side chain include glutamic acid and aspartic acid.

Basic: The residue has a positive charge due to association with H ion at physiological pH or within one or two pH units thereof (e.g., histidine) and the residue is attracted by aqueous solution so as to seek the surface positions in the conformation of a peptide in which it is contained when the peptide is in aqueous medium at physiological pH. Amino acids having a basic side chain include arginine, lysine and histidine.

Charged: The residues are charged at physiological pH and, therefore, include amino acids having acidic or basic side chains (i.e., glutamic acid, aspartic acid, arginine, lysine and histidine).

Hydrophobic: The residues are not charged at physiological pH and the residue is repelled by aqueous solution so as to seek the inner positions in the conformation of a peptide in which it is contained when the peptide is in aqueous medium. Amino acids having a hydrophobic side chain include tyrosine, valine, isoleucine, leucine, methionine, phenylalanine and tryptophan.

Neutral/polar: The residues are not charged at physiological pH, but the residue is not sufficiently repelled by aqueous solutions so that it would seek inner positions in the conformation of a peptide in which it is contained when the peptide is in aqueous medium. Amino acids having a neutral/polar side chain include asparagine, glutamine, cysteine, histidine, serine and threonine.

This description also characterizes certain amino acids as "small" since their side chains are not sufficiently large, even if polar groups are lacking, to confer hydrophobicity. With the exception of proline, "small" amino acids are those with four carbons or less when at least one polar group is on the side chain and three carbons or less when not. Amino acids having a small side chain include glycine, serine, alanine and threonine. The gene-encoded secondary amino acid proline is a special case due to its known effects on the secondary conformation of peptide chains. The structure of proline differs from all the other naturally-occurring amino acids in that its side chain is bonded to the nitrogen of the α-amino group, as well as the α-carbon. Several amino acid similarity matrices (e.g., PAM120 matrix and PAM250 matrix as disclosed for example by Dayhoff et al. (1978) A model of evolutionary change in proteins. Matrices for determining distance relationships In M. O. Dayhoff, (ed.), Atlas of protein sequence and structure, Vol. 5, pp. 345-358, National Biomedical Research Foundation, Washington D.C.; and by Gonnet et al., 1992, *Science* 256 (5062): 144301445), however, include proline in the same group as glycine, serine, alanine and threonine. Accordingly, for the purposes of the present invention, proline is classified as a "small" amino acid.

The degree of attraction or repulsion required for classification as polar or nonpolar is arbitrary and, therefore, amino acids specifically contemplated by the invention have been classified as one or the other. Most amino acids not specifically named can be classified on the basis of known behavior.

Amino acid residues can be further sub-classified as cyclic or noncyclic, and aromatic or nonaromatic, self-explanatory classifications with respect to the side-chain substituent groups of the residues, and as small or large. The residue is considered small if it contains a total of four carbon atoms or less, inclusive of the carboxyl carbon, provided an additional polar substituent is present; three or less if not. Small residues are, of course, always nonaromatic. Dependent on their structural properties, amino acid residues may fall in two or more classes. For the naturally-occurring protein amino acids, subclassification according to the this scheme is presented in the Table 3.

Conservative amino acid substitution also includes groupings based on side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. For example, it is reasonable to expect that replacement of a leucine with an isoleucine or valine, an aspartate with a glutamate, a threonine with a serine, or a similar replacement of an amino acid with a structurally related amino acid will not have a major effect on the properties of the resulting variant polypeptide. Whether an amino acid change results in a functional HVI marker polypeptide can readily be determined by assaying its activity. Conservative substitutions are shown in Table 4 below under the heading of exemplary substitutions. More preferred substitutions are shown under the heading of preferred substitutions. Amino acid substitutions falling within the scope of the invention, are, in general, accomplished by selecting substitutions that do not differ significantly in their effect on maintaining (a) the structure of the peptide backbone in the area of the substitution, (b) the charge or hydrophobicity of the molecule at the target site, or (c) the bulk of the side chain. After the substitutions are introduced, the variants are screened for biological activity.

Alternatively, similar amino acids for making conservative substitutions can be grouped into three categories based on the identity of the side chains. The first group includes glutamic acid, aspartic acid, arginine, lysine, histidine, which all have charged side chains; the second group includes glycine, serine, threonine, cysteine, tyrosine, glutamine, asparagine; and the third group includes leucine, isoleucine, valine, alanine, proline, phenylalanine, tryptophan, methionine, as described in Zubay, G., *Biochemistry*, third edition, Wm.C. Brown Publishers (1993).

Thus, a predicted non-essential amino acid residue in an HVI marker polypeptide is typically replaced with another amino acid residue from the same side chain family. Alternatively, mutations can be introduced randomly along all or part of an HVI marker gene coding sequence, such as by saturation mutagenesis, and the resultant mutants can be screened for an activity of the parent polypeptide to identify mutants which retain that activity. Following mutagenesis of the coding sequences, the encoded peptide can be expressed recombinantly and the activity of the peptide can be determined.

Accordingly, the present invention also contemplates variants of the naturally-occurring HVI marker polypeptide sequences or their biologically-active fragments, wherein the variants are distinguished from the naturally-occurring sequence by the addition, deletion, or substitution of one or more amino acid residues. In general, variants will display at least about 30, 40, 50, 55, 60, 65, 70, 75, 80, 85, 90, 91, 92, 93, 94, 95, 96, 97, 98, 99% similarity to a parent HVI marker polypeptide sequence as, for example, set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114. Desirably, variants will have at least 30, 40, 50, 55, 60, 65, 70, 75, 80, 85, 90, 91, 92, 93, 94, 95, 96, 97, 98, 99% sequence identity to a parent HVI marker polypeptide sequence as, for example, set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114. Moreover, sequences differing from the native or parent sequences by the addition, deletion, or substitution of 1, 2, 3, 4, 5, 6, 7, 8, 9, 10, 11, 12, 13, 14, 15, 16, 17, 18, 19, 20, 30, 40, 50, 60, 70, 80, 90, 100, 150, 200, 300, 500 or more amino acids but which retain the properties of the parent HVI marker polypeptide are contemplated. HVI marker polypeptides also include polypeptides that are encoded by polynucleotides that hybridize under stringency conditions as defined herein, especially high stringency conditions, to the HVI marker polynucleotide sequences of the invention, or the non-coding strand thereof, as described above.

In one embodiment, variant polypeptides differ from an HVI marker sequence by at least one but by less than 50, 40, 30, 20, 15, 10, 8, 6, 5, 4, 3 or 2 amino acid residue(s). In another, variant polypeptides differ from the corresponding sequence in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114 by at least 1% but less than 20%, 15%, 10% or 5% of the residues. (If this comparison requires alignment the sequences should be aligned for maximum similarity. "Looped" out sequences from deletions or insertions, or mismatches, are considered differences). The differences are, suitably, differences or changes at a non-essential residue or a conservative substitution.

A "non-essential" amino acid residue is a residue that can be altered from the wild-type sequence of an embodiment polypeptide without abolishing or substantially altering one or more of its activities. Suitably, the alteration does not substantially alter one of these activities, for example, the activity is at least 20%, 40%, 60%, 70% or 80% of wild-type. An "essential" amino acid residue is a residue that, when altered from the wild-type sequence of an HVI marker polypeptide of the invention, results in abolition of an activity of the parent molecule such that less than 20% of the wild-type activity is present.

In other embodiments, a variant polypeptide includes an amino acid sequence having at least about 50%, 55%, 60%, 65%, 70%, 75%, 80%, 85%, 90%, 91%, 92%, 93%, 94% 95%, 96%, 97%, 98% or more similarity to a corresponding sequence of an HVI marker polypeptide as, for example, set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114 and has the activity of that HVI marker polypeptide.

HVI marker polypeptides of the invention may be prepared by any suitable procedure known to those of skill in the art. For example, the polypeptides may be prepared by a procedure including the steps of: (a) preparing a chimeric construct comprising a nucleotide sequence that encodes at least a portion of an HVI marker polynucleotide and that is operably linked to a regulatory element; (b) introducing the chimeric construct into a host cell; (c) culturing the host cell to express the HVI marker polypeptide; and (d) isolating the HVI marker polypeptide from the host cell. In illustrative examples, the nucleotide sequence encodes at least a portion of the sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114 or a variant thereof.

The chimeric construct is typically in the form of an expression vector, which is suitably selected from self-replicating extra-chromosomal vectors (e.g., plasmids) and vectors that integrate into a host genome.

The regulatory element will generally be appropriate for the host cell employed for expression of the HVI marker polynucleotide. Numerous types of expression vectors and regulatory elements are known in the art for a variety of host cells. Illustrative elements of this type include, but are not restricted to, promoter sequences (e.g., constitutive or inducible promoters which may be naturally occurring or combine elements of more than one promoter), leader or signal sequences, ribosomal binding sites, transcriptional start and stop sequences, translational start and termination sequences, and enhancer or activator sequences.

In some embodiments, the expression vector comprises a selectable marker gene to permit the selection of transformed host cells. Selectable marker genes are well known in the art and will vary with the host cell employed.

The expression vector may also include a fusion partner (typically provided by the expression vector) so that the HVI marker polypeptide is produced as a fusion polypeptide with the fusion partner. The main advantage of fusion partners is that they assist identification and/or purification of the fusion polypeptide. In order to produce the fusion polypeptide, it is necessary to ligate the HVI marker polynucleotide into an expression vector so that the translational reading frames of the fusion partner and the HVI marker polynucleotide coincide. Well known examples of fusion partners include, but are not limited to, glutathione-S-transferase (GST), Fc portion of human IgG, maltose binding protein (MBP) and hexahistidine ($HIS_6$), which are particularly useful for isolation of the fusion polypeptide by affinity chromatography. In some embodiments, fusion polypeptides are purified by affinity chromatography using matrices to which the fusion partners bind such as but not limited to glutathione-, amylose-, and nickel- or cobalt-conjugated resins. Many such matrices are available in "kit" form, such as the QIAexpress™ system (Qiagen) useful with ($HIS_6$) fusion partners and the Pharmacia GST purification system. Other fusion partners known in the art are light-emitting proteins such as green fluorescent protein (GFP) and luciferase, which serve as fluorescent "tags" that permit the identification and/or isolation of fusion polypeptides by fluorescence microscopy or by flow cytometry. Flow cytometric methods such as fluorescence activated cell sorting (FACS) are particularly useful in this latter application.

Desirably, the fusion partners also possess protease cleavage sites, such as for Factor $X_a$ or Thrombin, which permit the relevant protease to partially digest the fusion polypeptide and thereby liberate the HVI marker polypeptide from the fusion construct. The liberated polypeptide can then be isolated from the fusion partner by subsequent chromatographic separation.

Fusion partners also include within their scope "epitope tags," which are usually short peptide sequences for which a specific antibody is available. Well known examples of epitope tags for which specific monoclonal antibodies are readily available include c-Myc, influenza virus, haemagglutinin and FLAG tags.

The chimeric constructs of the invention are introduced into a host by any suitable means including "transduction" and "transfection", which are art recognized as meaning the introduction of a nucleic acid, for example, an expression vector, into a recipient cell by nucleic acid-mediated gene transfer. "Transformation," however, refers to a process in which a host's genotype is changed as a result of the cellular uptake of exogenous DNA or RNA, and, for example, the transformed cell comprises the expression system of the invention. There are many methods for introducing chimeric constructs into cells. Typically, the method employed will depend on the choice of host cell. Technology for introduction of chimeric constructs into host cells is well known to those of skill in the art. Four general classes of methods for delivering nucleic acid molecules into cells have been described: (1) chemical methods such as calcium phosphate precipitation, polyethylene glycol (PEG)-mediate precipitation and lipofection; (2) physical methods such as microinjection, electroporation, acceleration methods and vacuum infiltration; (3) vector based methods such as bacterial and viral vector-mediated transformation; and (4) receptor-mediated. Transformation techniques that fall within these and other classes are well known to workers in the art, and new techniques are continually becoming known. The particular choice of a transformation technology will be determined by its efficiency to transform certain host species as well as the experience and preference of the person practising the invention with a particular methodology of choice. It will be apparent to the skilled person that the particular choice of a transformation system to introduce a chimeric construct into cells is not essential to or a limitation of the invention, provided it achieves an acceptable level of nucleic acid transfer.

Recombinant HVI marker polypeptides may be produced by culturing a host cell transformed with a chimeric construct. The conditions appropriate for expression of the HVI marker polynucleotide will vary with the choice of expression vector and the host cell and are easily ascertained by one skilled in the art through routine experimentation. Suitable host cells for expression may be prokaryotic or eukaryotic. An illustrative host cell for expression of a polypeptide of the invention is a bacterium. The bacterium used may be *Escherichia coli*. Alternatively, the host cell may be a yeast cell or an insect cell such as, for example, SF9 cells that may be utilized with a baculovirus expression system.

Recombinant HVI marker polypeptides can be conveniently prepared using standard protocols as described for example in Sambrook, et al., (1989, supra), in particular Sections 16 and 17; Ausubel et al., (1994, supra), in particular Chapters 10 and 16; and Coligan et al., CURRENT PROTOCOLS IN PROTEIN SCIENCE (John Wiley & Sons, Inc. 1995-1997), in particular Chapters 1, 5 and 6. Alternatively, the HVI marker polypeptides may be synthesized by chemical synthesis, e.g., using solution synthesis or solid phase synthesis as described, for example, in Chapter 9 of Atherton and Shephard (supra) and in Roberge et al (1995, *Science* 269: 202).

4. Antigen-Binding Molecules

The invention also provides antigen-binding molecules that are specifically immuno-interactive with an HVI marker polypeptide of the invention. In one embodiment, the antigen-binding molecule comprise whole polyclonal antibodies. Such antibodies may be prepared, for example, by injecting an HVI marker polypeptide of the invention into a production species, which may include mice or rabbits, to obtain polyclonal antisera. Methods of producing polyclonal antibodies are well known to those skilled in the art. Exemplary protocols which may be used are described for example in Coligan et al., CURRENT PROTOCOLS IN IMMUNOLOGY, (John Wiley & Sons, Inc, 1991), and Ausubel et al., (1994-1998, supra), in particular Section III of Chapter 11.

In lieu of polyclonal antisera obtained in a production species, monoclonal antibodies may be produced using the standard method as described, for example, by Köhler and Milstein (1975, *Nature* 256, 495-497), or by more recent modifications thereof as described, for example, in Coligan et al., (1991, supra) by immortalising spleen or other antibody producing cells derived from a production species which has been inoculated with one or more of the HVI marker polypeptides of the invention.

The invention also contemplates as antigen-binding molecules Fv, Fab, Fab' and F(ab')$_2$ immunoglobulin fragments. Alternatively, the antigen-binding molecule may comprise a synthetic stabilized Fv fragment. Exemplary fragments of this type include single chain Fv fragments (sFv, frequently termed scFv) in which a peptide linker is used to bridge the N terminus or C terminus of a $V_H$ domain with the C terminus or N-terminus, respectively, of a $V_L$ domain. ScFv lack all constant parts of whole antibodies and are not able to activate complement. ScFvs may be prepared, for example, in accordance with methods outlined in Kreber et al (Kreber et al. 1997, *J. Immunol. Methods;* 201 (1): 35-55). Alternatively, they may be prepared by methods described in U.S. Pat. No. 5,091,513, European Patent No 239,400 or the articles by Winter and Milstein (1991, *Nature* 349:293) and Plückthun et al (1996, In *Antibody engineering: A practical approach.* 203-252). In another embodiment, the synthetic stabilized Fv fragment comprises a disulfide stabilized Fv (dsFv) in which cysteine residues are introduced into the $V_H$ and $V_L$ domains such that in the fully folded Fv molecule the two residues will form a disulfide bond between them. Suitable methods of producing dsFv are described for example in (Glockscuther et al. *Biochem.* 29: 1363-1367; Reiter et al. 1994, *J. Biol. Chem.* 269: 18327-18331; Reiter et al. 1994, *Biochem.* 33: 5451-5459; Reiter et al. 1994. *Cancer Res.* 54: 2714-2718; Webber et al. 1995, *Mol. Immunol.* 32: 249-258).

Phage display and combinatorial methods for generating anti-HVI marker polypeptide antigen-binding molecules are known in the art (as described in, e.g., Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) *Bio/Technology* 9:1370-1372; Hay et al. (1992) *Hum Antibod Hybridomas* 3:81-85; Huse et al. (1989) *Science* 246:1275-1281; Griffths et al. (1993) *EMBO J* 12:725-734; Hawkins et al. (1992) *J Mol Biol* 226:889-896; Clackson et al. (1991) *Nature* 352:624-628; Gram et al. (1992) *PNAS* 89:3576-3580; Garrad et al. (1991) *Bio/Technology* 9:1373-1377; Hoogenboom et al. (1991) *Nuc Acid Res* 19:4133-4137; and Barbas et al. (1991) *PNAS* 88:7978-7982). The antigen-binding molecules can be used to screen expression libraries for variant HVI marker polypeptides. They can also be used to detect and/or isolate the HVI marker polypeptides of the invention. Thus, the invention also contemplates the use of antigen-binding molecules to isolate HVI marker polypeptides using, for example, any suitable immunoaffinity based method including, but not limited to, immunochromatography and immunoprecipitation. A suitable method utilizes solid phase adsorption in which anti-HVI marker polypeptide antigen-binding molecules are attached to a suitable resin, the resin is contacted with a sample suspected of containing an HVI marker polypeptide, and the HVI marker polypeptide, if any, is subsequently eluted from the resin. Illustrative resins include: Sepharose™ (Pharmacia), Poros™ resins (Roche Molecular Biochemicals, Indianapolis), Actigel Superflow™ resins (Sterogene Bioseparations Inc., Carlsbad Calif.), and Dynabeads™ (Dynal Inc., Lake Success, N.Y.).

The antigen-binding molecule can be coupled to a compound, e.g., a label such as a radioactive nucleus, or imaging agent, e.g. a radioactive, enzymatic, or other, e.g., imaging agent, e.g., a NMR contrast agent. Labels which produce detectable radioactive emissions or fluorescence are preferred. An anti-HVI marker polypeptide antigen-binding molecule (e.g., monoclonal antibody) can be used to detect HVI marker polypeptides (e.g., in a cellular lysate or cell supernatant) in order to evaluate the abundance and pattern of expression of the protein. In certain advantageous application in accordance with the present invention, such antigen-binding molecules can be used to monitor HVI marker polypeptides levels in biological samples (including whole cells and fluids) for diagnosing the presence, absence, degree, of herpes virus infection or risk of development of disease as a consequences of herpes virus infection. Detection can be facilitated by coupling (i.e., physically linking) the antibody to a detectable substance (i.e., antibody labeling). Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$. The label may be selected from a group including a chromogen, a catalyst, an enzyme, a fluorophore, a chemiluminescent molecule, a lanthanide ion such as Europium ($Eu^{34}$), a radioisotope and a direct visual label. In the case of a direct visual label, use may be made of a colloidal metallic or non-metallic particle, a dye particle, an enzyme or a substrate, an organic polymer, a latex particle, a liposome, or other vesicle containing a signal producing substance and the like.

A large number of enzymes useful as labels is disclosed in United States patent Specifications U.S. Pat. No. 4,366,241, U.S. Pat. No. 4,843,000, and U.S. Pat. No. 4,849,338. Enzyme labels useful in the present invention include alkaline phosphatase, horseradish peroxidase, luciferase, β-galactosidase, glucose oxidase, lysozyme, malate dehydrogenase and the like. The enzyme label may be used alone or in combination with a second enzyme in solution.

5. Methods of Detecting Aberrant HVI Marker Gene Expression or Alleles

The present invention is predicated in part on the discovery that horses infected with a herpes virus (especially EHV), and typically those with an active herpes virus infection, have aberrant expression of certain genes or certain alleles of genes, referred to herein as HVI marker genes, as compared to horses not infected with the herpes virus. It is proposed that aberrant expression of these genes or their homologues or orthologues will be found in other animals with herpes virus infection. Accordingly, the present invention features a method for assessing herpes virus infection or for diagnosing herpes virus infection, especially active herpes virus infection, in a subject, which is suitably a mammal, by detecting aberrant expression of an HVI marker gene in a biological sample obtained from the subject. Suitably, the herpes virus infection includes infection by a member of a herpes virus subfamily selected from alpha herpes virinae, beta herpes virinae and gamma herpes virinae. Illustrative examples of herpes viruses from the alpha herpes virinae subfamily include HHV-1 (HSV-1), HHV-2 (HSV-2), HHV-3 (VZV), and equine herpes viruses (e.g., EHV-1 and EHV-4). Non-limiting examples of herpes viruses from the beta herpes virinae subfamily include HHV-5 (CMV), HHV-6 (roseolovirus) and HHV-7. Representative examples of herpes viruses from the gamma herpes virinae subfamily include, but are not limited to, HHV-4 (lymphocryptovirus, EBV), and HHV-8 (rhadinovirus). In specific embodiments, the herpes virus is EHV, especially EHV-1 and more especially active EHV-1.

In order to make the assessment or the diagnosis, it will be desirable to qualitatively or quantitatively determine the levels of HVI marker gene transcripts, or the presence of levels of particular alleles of an HVI marker gene, or the level or functional activity of HVI marker polypeptides. In some embodiments, the presence, degree or stage of herpes virus infection or risk of development of herpes virus sequelae is diagnosed when an HVI marker gene product is present at a detectably lower level in the biological sample as compared to the level at which that gene is present in a reference sample obtained from normal subjects or from subjects not infected with herpes virus, especially not actively infected with herpes virus. In other embodiments, the presence, degree or stage of herpes virus infection or risk of development of herpes virus sequelae is diagnosed when an HVI marker gene product is present at a detectably higher level in the biological sample as compared to the level at which that gene is present in a reference sample obtained from normal subjects or from subjects not infected with herpes virus, especially not actively infected with herpes virus. Generally, such diagnoses are made when the level or functional activity of an HVI marker gene product in the biological sample varies from the level or functional activity of a corresponding HVI marker gene product in the reference sample by at least 10%, 20%, 30%, 40%, 50%, 60%, 70%, 80%, 90%, 92%, 94%, 96%, 97%, 98% or 99%, or even by at least about 99.5%, 99.9%, 99.95% or 99.99%, 99.995% or 99.999%, or even by at least about 100%, 200%, 300%, 400%, 500%, 600%, 700%, 800%, 900% or 1000%. Illustrative increases or decreases in the expression level of representative HVI marker genes are shown in Tables 5-7.

The corresponding gene product is generally selected from the same gene product that is present in the biological sample, a gene product expressed from a variant gene (e.g., an homologous or orthologous gene) including an allelic variant, or a splice variant or protein product thereof. In some embodiments, the method comprises measuring the level or functional activity of individual expression products of at least about 2, 3, 4, 5, 6, 7, 8, 9, 10, 11, 12, 13, 14, 15, 16, 17, 18, 19, 20, 21, 22, 23, 24, 25, 26, 27, 28, 29 or 30 HVI marker genes.

Generally, the biological sample contains blood, especially peripheral blood, or a fraction or extract thereof. Typically, the biological sample comprises blood cells such as mature, immature and developing leukocytes, including lymphocytes, polymorphonuclear leukocytes, neutrophils, monocytes, reticulocytes, basophils, coelomocytes, haemocytes, eosinophils, megakaryocytes, macrophages, dendritic cells natural killer cells, or fraction of such cells (e.g., a nucleic acid or protein fraction). In specific embodiments, the biological sample comprises leukocytes including peripheral blood mononuclear cells (PBMC).

5.1 Nucleic Acid-Based Diagnostics

Nucleic acid used in polynucleotide-based assays can be isolated from cells contained in the biological sample, according to standard methodologies (Sambrook, et al., 1989, supra; and Ausubel et al., 1994, supra). The nucleic acid is typically fractionated (e.g., poly $A^+$ RNA) or whole cell RNA. Where RNA is used as the subject of detection, it may be desired to convert the RNA to a complementary DNA. In some embodiments, the nucleic acid is amplified by a template-dependent nucleic acid amplification technique. A number of template dependent processes are available to amplify the HVI marker sequences present in a given template sample. An exemplary nucleic acid amplification technique is the polymerase chain reaction (referred to as PCR) which is described in detail in U.S. Pat. Nos. 4,683,195, 4,683,202 and 4,800,159, Ausubel et al. (supra), and in Innis et al., ("PCR Protocols", Academic Press, Inc., San Diego Calif., 1990). Briefly, in PCR, two primer sequences are prepared that are complementary to regions on opposite complementary strands of the marker sequence. An excess of deoxynucleoside triphosphates are added to a reaction mixture along with a DNA polymerase, e.g., Taq polymerase. If a cognate HVI marker sequence is present in a sample, the primers will bind to the marker and the polymerase will cause the primers to be extended along the marker sequence by adding on nucleotides. By raising and lowering the temperature of the reaction mixture, the extended primers will dissociate from the marker to form reaction products, excess primers will bind to the marker and to the reaction products and the process is repeated. A reverse transcriptase PCR amplification procedure may be performed in order to quantify the amount of mRNA amplified. Methods of reverse transcribing RNA into cDNA are well known and described in Sambrook et al., 1989, supra. Alternative methods for reverse transcription utilize thermostable, RNA-dependent DNA polymerases. These methods are described in WO 90/07641. Polymerase chain reaction methodologies are well known in the art.

In certain advantageous embodiments, the template-dependent amplification involves the quantification of transcripts in real-time. For example, RNA or DNA may be quantified using the Real-Time PCR technique (Higuchi, 1992, et al., *Biotechnology* 10: 413-417). By determining the concentration of the amplified products of the target DNA in PCR reactions that have completed the same number of cycles and are in their linear ranges, it is possible to determine the relative concentrations of the specific target sequence in the original DNA mixture. If the DNA mixtures are cDNAs synthesized from RNAs isolated from different tissues or cells, the relative abundance of the specific mRNA from which the target sequence was derived can be determined for the respective tissues or cells. This direct proportionality between the concentration of the PCR products and the relative mRNA abundance is only true in the linear range of the PCR reaction. The final concentration of the target DNA in the plateau portion of the curve is determined by the availability of reagents in the reaction mix and is independent of the original concentration of target DNA.

Another method for amplification is the ligase chain reaction ("LCR"), disclosed in EPO No. 320 308. In LCR, two complementary probe pairs are prepared, and in the presence of the target sequence, each pair will bind to opposite complementary strands of the target such that they abut. In the presence of a ligase, the two probe pairs will link to form a single unit. By temperature cycling, as in PCR, bound ligated units dissociate from the target and then serve as "target sequences" for ligation of excess probe pairs. U.S. Pat. No. 4,883,750 describes a method similar to LCR for binding probe pairs to a target sequence.

Qβ Replicase, described in PCT Application No. PCT/US87/00880, may also be used. In this method, a replicative sequence of RNA that has a region complementary to that of a target is added to a sample in the presence of an RNA polymerase. The polymerase will copy the replicative sequence that can then be detected.

An isothermal amplification method, in which restriction endonucleases and ligases are used to achieve the amplification of target molecules that contain nucleotide 5'-α-thiotriphosphates in one strand of a restriction site may also be useful in the amplification of nucleic acids in the present invention, Walker et al., (1992, *Proc. Natl. Acad. Sci. U.S.A* 89: 392-396).

Strand Displacement Amplification (SDA) is another method of carrying out isothermal amplification of nucleic acids which involves multiple rounds of strand displacement and synthesis, i.e., nick translation. A similar method, called Repair Chain Reaction (RCR), involves annealing several probes throughout a region targeted for amplification, followed by a repair reaction in which only two of the four bases are present. The other two bases can be added as biotinylated derivatives for easy detection. A similar approach is used in SDA. Target specific sequences can also be detected using a cyclic probe reaction (CPR). In CPR, a probe having 3' and 5' sequences of non-specific DNA and a middle sequence of specific RNA is hybridized to DNA that is present in a sample. Upon hybridization, the reaction is treated with RNase H, and the products of the probe identified as distinctive products that are released after digestion. The original template is annealed to another cycling probe and the reaction is repeated.

Still another amplification method described in GB Application No. 2 202 328, and in PCT Application No. PCT/US89/01025, may be used. In the former application, "modified" primers are used in a PCR-like, template- and enzyme-dependent synthesis. The primers may be modified by labeling with a capture moiety (e.g., biotin) and/or a detector moiety (e.g., enzyme). In the latter application, an excess of labeled probes are added to a sample. In the presence of the target sequence, the probe binds and is cleaved catalytically. After cleavage, the target sequence is released intact to be bound by excess probe. Cleavage of the labeled probe signals the presence of the target sequence.

Other nucleic acid amplification procedures include transcription-based amplification systems (TAS), including nucleic acid sequence based amplification (NASBA) and 3SR (Kwoh et al., 1989, *Proc. Natl. Acad. Sci. U.S.A.*, 86: 1173; Gingeras et al., PCT Application WO 88/10315). In NASBA, the nucleic acids can be prepared for amplification by standard phenol/chloroform extraction, heat denaturation of a clinical sample, treatment with lysis buffer and minispin columns for isolation of DNA and RNA or guanidinium chloride extraction of RNA. These amplification techniques involve annealing a primer which has target specific sequences. Following polymerization, DNA/RNA hybrids are digested with RNase H while double stranded DNA molecules are heat denatured again. In either case the single stranded DNA is made fully double stranded by addition of second target specific primer, followed by polymerization. The double-stranded DNA molecules are then multiply transcribed by an RNA polymerase such as T7 or SP6. In an isothermal cyclic reaction, the RNAs are reverse transcribed into single stranded DNA, which is then converted to double stranded DNA, and then transcribed once again with an RNA polymerase such as T7 or SP6. The resulting products, whether truncated or complete, indicate target specific sequences.

Davey et al., EPO No. 329 822 disclose a nucleic acid amplification process involving cyclically synthesizing single-stranded RNA ("ssRNA"), ssDNA, and double-stranded DNA (dsDNA), which may be used in accordance with the present invention. The ssRNA is a template for a first primer oligonucleotide, which is elongated by reverse transcriptase (RNA-dependent DNA polymerase). The RNA is then removed from the resulting DNA:RNA duplex by the action of ribonuclease H(RNase H, an RNase specific for RNA in duplex with either DNA or RNA). The resultant ssDNA is a template for a second primer, which also includes the sequences of an RNA polymerase promoter (exemplified by T7 RNA polymerase) 5' to its homology to the template. This primer is then extended by DNA polymerase (exemplified by the large "Klenow" fragment of *E. coli* DNA polymerase I), resulting in a double-stranded DNA ("dsDNA") molecule, having a sequence identical to that of the original RNA between the primers and having additionally, at one end, a promoter sequence. This promoter sequence can be used by the appropriate RNA polymerase to make many RNA copies of the DNA. These copies can then re-enter the cycle leading to very swift amplification. With proper choice of enzymes, this amplification can be done isothermally without addition of enzymes at each cycle. Because of the cyclical nature of this process, the starting sequence can be chosen to be in the form of either DNA or RNA.

Miller et al. in PCT Application WO 89/06700 disclose a nucleic acid sequence amplification scheme based on the hybridization of a promoter/primer sequence to a target single-stranded DNA ("ssDNA") followed by transcription of many RNA copies of the sequence. This scheme is not cyclic, i.e., new templates are not produced from the resultant RNA transcripts. Other amplification methods include "RACE" and "one-sided PCR" (Frohman, M. A., In: "PCR Protocols: A Guide to Methods and Applications", Academic Press, N.Y., 1990; Ohara et al., 1989, *Proc. Natl Acad. Sci. U.S.A.*, 86: 5673-567).

Methods based on ligation of two (or more) oligonucleotides in the presence of nucleic acid having the sequence of the resulting "di-oligonucleotide", thereby amplifying the di-oligonucleotide, may also be used for amplifying target nucleic acid sequences. Wu et al., (1989, *Genomics* 4: 560).

Depending on the format, the HVI marker nucleic acid of interest is identified in the sample directly using a template-dependent amplification as described, for example, above, or with a second, known nucleic acid following amplification. Next, the identified product is detected. In certain applications, the detection may be performed by visual means (e.g., ethidium bromide staining of a gel). Alternatively, the detection may involve indirect identification of the product via chemiluminescence, radioactive scintigraphy of radiolabel or fluorescent label or even via a system using electrical or thermal impulse signals (Affymax Technology; Bellus, 1994, *J Macromol. Sci. Pure, Appl. Chem., A*31 (1): 1355-1376).

In some embodiments, amplification products or "amplicons" are visualized in order to confirm amplification of the HVI marker sequences. One typical visualization method involves staining of a gel with ethidium bromide and visualization under UV light. Alternatively, if the amplification products are integrally labeled with radio- or fluorometrically-labeled nucleotides, the amplification products can then be exposed to x-ray film or visualized under the appropriate stimulating spectra, following separation. In some embodiments, visualization is achieved indirectly. Following separation of amplification products, a labeled nucleic acid probe is brought into contact with the amplified HVI marker sequence. The probe is suitably conjugated to a chromophore but may be radiolabeled. Alternatively, the probe is conjugated to a binding partner, such as an antigen-binding molecule, or biotin, and the other member of the binding pair carries a detectable moiety or reporter molecule. The techniques involved are well known to those of skill in the art and can be found in many standard texts on molecular protocols (e.g., see Sambrook et al., 1989, supra and Ausubel et al. 1994, supra). For example, chromophore or radiolabel probes or primers identify the target during or following amplification.

In certain embodiments, target nucleic acids are quantified using blotting techniques, which are well known to those of skill in the art. Southern blotting involves the use of DNA as a target, whereas Northern blotting involves the use of RNA as a target. Each provide different types of information, although cDNA blotting is analogous, in many aspects, to blotting or RNA species. Briefly, a probe is used to target a DNA or RNA species that has been immobilized on a suitable matrix, often a filter of nitrocellulose. The different species should be spatially separated to facilitate analysis. This often is accomplished by gel electrophoresis of nucleic acid species followed by "blotting" on to the filter. Subsequently, the blotted target is incubated with a probe (usually labeled) under conditions that promote denaturation and rehybridization. Because the probe is designed to base pair with the target, the probe will bind a portion of the target sequence under renaturing conditions. Unbound probe is then removed, and detection is accomplished as described above.

Following detection/quantification, one may compare the results seen in a given subject with a control reaction or a statistically significant reference group of normal subjects or of subjects free of herpes virus infection, especially free of active herpes virus infection. In this way, it is possible to correlate the amount of an HVI marker nucleic acid detected with the progression or severity of the disease.

Also contemplated are genotyping methods and allelic discrimination methods and technologies such as those described by Kristensen et al. (Biotechniques 30 (2): 318-322), including the use of single nucleotide polymorphism analysis, high performance liquid chromatography, TaqMan™, liquid chromatography, and mass spectrometry.

Also contemplated are biochip-based technologies such as those described by Hacia et al. (1996, *Nature Genetics* 14: 441-447) and Shoemaker et al. (1996, *Nature Genetics* 14: 450-456). Briefly, these techniques involve quantitative methods for analysing large numbers of genes rapidly and accurately. By tagging genes with oligonucleotides or using fixed probe arrays, one can employ biochip technology to segregate target molecules as high density arrays and screen these molecules on the basis of hybridization. See also Pease et al. (1994, *Proc. Natl. Acad. Sci. U.S.A.* 91: 5022-5026); Fodor et al. (1991, *Science* 251: 767-773). Briefly, nucleic acid probes to HVI marker polynucleotides are made and attached to biochips to be used in screening and diagnostic methods, as outlined herein. The nucleic acid probes attached to the biochip are designed to be substantially complementary to specific expressed HVI marker nucleic acids, i.e., the target sequence (either the target sequence of the sample or to other probe sequences, for example in sandwich assays), such that hybridization of the target sequence and the probes of the present invention occurs. This complementarity need not be perfect; there may be any number of base pair mismatches which will interfere with hybridization between the target sequence and the nucleic acid probes of the present invention. However, if the number of mismatches is so great that no hybridization can occur under even the least stringent of hybridization conditions, the sequence is not a complementary target sequence. In certain embodiments, more than one probe per sequence is used, with either overlapping probes or probes to different sections of the target being used. That is, two, three, four or more probes, with three being desirable, are used to build in a redundancy for a particular target. The probes can be overlapping (i.e. have some sequence in common), or separate.

As will be appreciated by those of ordinary skill in the art, nucleic acids can be attached to or immobilized on a solid support in a wide variety of ways. By "immobilized" and grammatical equivalents herein is meant the association or binding between the nucleic acid probe and the solid support is sufficient to be stable under the conditions of binding, washing, analysis, and removal as outlined below. The binding can be covalent or non-covalent. By "non-covalent binding" and grammatical equivalents herein is meant one or more of either electrostatic, hydrophilic, and hydrophobic interactions. Included in non-covalent binding is the covalent attachment of a molecule, such as, streptavidin to the support and the non-covalent binding of the biotinylated probe to the streptavidin. By "covalent binding" and grammatical equivalents herein is meant that the two moieties, the solid support and the probe, are attached by at least one bond, including sigma bonds, pi bonds and coordination bonds. Covalent bonds can be formed directly between the probe and the solid support or can be formed by a cross linker or by inclusion of a specific reactive group on either the solid support or the probe or both molecules. Immobilisation may also involve a combination of covalent and non-covalent interactions.

In general, the probes are attached to the biochip in a wide variety of ways, as will be appreciated by those in the art. As described herein, the nucleic acids can either be synthesized first, with subsequent attachment to the biochip, or can be directly synthesized on the biochip.

The biochip comprises a suitable solid or semi-solid substrate or solid support. By "substrate" or "solid support" is meant any material that can be modified to contain discrete individual sites appropriate for the attachment or association of the nucleic acid probes and is amenable to at least one detection method. As will be appreciated by practitioners in the art, the number of possible substrates are very large, and include, but are not limited to, glass and modified or functionalized glass, plastics (including acrylics, polystyrene and copolymers of styrene and other materials, polypropylene, polyethylene, polybutylene, polyurethanes, Teflon™, etc.), polysaccharides, nylon or nitrocellulose, resins, silica or silica-based materials including silicon and modified silicon, carbon, metals, inorganic glasses, plastics, etc. In general, the substrates allow optical detection and do not appreciably fluorescese.

Generally the substrate is planar, although as will be appreciated by those of skill in the art, other configurations of substrates may be used as well. For example, the probes may be placed on the inside surface of a tube, for flow-through sample analysis to minimize sample volume. Similarly, the substrate may be flexible, such as a flexible foam, including closed cell foams made of particular plastics.

In certain embodiments, oligonucleotides probes are synthesized on the substrate, as is known in the art. For example, photoactivation techniques utilizing photopolymerization compounds and techniques can be used. In an illustrative example, the nucleic acids are synthesized in situ, using well known photolithographic techniques, such as those described in WO 95/25116; WO 95/35505; U.S. Pat. Nos. 5,700,637 and 5,445,934; and references cited within; these methods of attachment form the basis of the Affymetrix GeneChip™ technology.

In an illustrative biochip analysis, oligonucleotide probes on the biochip are exposed to or contacted with a nucleic acid sample suspected of containing one or more herpes virus polynucleotides under conditions favouring specific hybridization. Sample extracts of DNA or RNA, either single or double-stranded, may be prepared from fluid suspensions of biological materials, or by grinding biological materials, or following a cell lysis step which includes, but is not limited to, lysis effected by treatment with SDS (or other detergents), osmotic shock, guanidinium isothiocyanate and lysozyme. Suitable DNA, which may be used in the method of the invention, includes cDNA. Such DNA may be prepared by any one of a number of commonly used protocols as for example described in Ausubel, et al., 1994, supra, and Sambrook, et al., et al., 1989, supra.

Suitable RNA, which may be used in the method of the invention, includes messenger RNA, complementary RNA transcribed from DNA (cRNA) or genomic or subgenomic RNA. Such RNA may be prepared using standard protocols as for example described in the relevant sections of Ausubel, et al. 1994, supra and Sambrook, et al. 1989, supra).

cDNA may be fragmented, for example, by sonication or by treatment with restriction endonucleases. Suitably, cDNA is fragmented such that resultant DNA fragments are of a length greater than the length of the immobilized oligonucleotide probe(s) but small enough to allow rapid access thereto under suitable hybridization conditions. Alternatively, fragments of cDNA may be selected and amplified using a suitable nucleotide amplification technique, as described for example above, involving appropriate random or specific primers.

Usually the target HVI marker polynucleotides are detectably labeled so that their hybridization to individual probes can be determined. The target polynucleotides are typically detectably labeled with a reporter molecule illustrative examples of which include chromogens, catalysts, enzymes, fluorochromes, chemiluminescent molecules, bioluminescent molecules, lanthanide ions (e.g., $Eu^{34}$), a radioisotope and a direct visual label. In the case of a direct visual label, use may be made of a colloidal metallic or non-metallic particle, a dye particle, an enzyme or a substrate, an organic polymer, a latex particle, a liposome, or other vesicle containing a signal producing substance and the like. Illustrative labels of this type include large colloids, for example, metal colloids such as those from gold, selenium, silver, tin and titanium oxide. In some embodiments in which an enzyme is used as a direct visual label, biotinylated bases are incorporated into a target polynucleotide. Hybridization is detected by incubation with streptavidin-reporter molecules.

Suitable fluorochromes include, but are not limited to, fluorescein isothiocyanate (FITC), tetramethylrhodamine isothiocyanate (TRITC), R-Phycoerythrin (RPE), and Texas Red. Other exemplary fluorochromes include those discussed by Dower et al. (International Publication WO 93/06121). Reference also may be made to the fluorochromes described in U.S. Pat. Nos. 5,573,909 (Singer et al), 5,326,692 (Brinkley et al). Alternatively, reference may be made to the fluorochromes described in U.S. Pat. Nos. 5,227,487, 5,274,113, 5,405,975, 5,433,896, 5,442,045, 5,451,663, 5,453,517, 5,459,276, 5,516,864, 5,648,270 and 5,723,218. Commercially available fluorescent labels include, for example, fluorescein phosphoramidites such as Fluoreprime™ (Pharmacia), Fluoredite™ (Millipore) and FAM (Applied Biosystems International)

Radioactive reporter molecules include, for example, $^{32}P$, which can be detected by an X-ray or phosphoimager techniques.

The hybrid-forming step can be performed under suitable conditions for hybridizing oligonucleotide probes to test nucleic acid including DNA or RNA. In this regard, reference may be made, for example, to NUCLEIC ACID HYBRIDIZATION, A PRACTICAL APPROACH (Homes and Higgins, eds.) (IRL press, Washington D.C., 1985). In general, whether hybridization takes place is influenced by the length of the oligonucleotide probe and the polynucleotide sequence under test, the pH, the temperature, the concentration of mono- and divalent cations, the proportion of G and C nucleotides in the hybrid-forming region, the viscosity of the medium and the possible presence of denaturants. Such variables also influence the time required for hybridization. The preferred conditions will therefore depend upon the particular application. Such empirical conditions, however, can be routinely determined without undue experimentation.

In certain advantageous embodiments, high discrimination hybridization conditions are used. For example, reference may be made to Wallace et al. (1979, *Nucl. Acids Res.* 6: 3543) who describe conditions that differentiate the hybridization of 11 to 17 base long oligonucleotide probes that match perfectly and are completely homologous to a target sequence as compared to similar oligonucleotide probes that contain a single internal base pair mismatch. Reference also may be made to Wood et al. (1985, *Proc. Natl. Acid. Sci. USA* 82: 1585) who describe conditions for hybridization of 11 to 20 base long oligonucleotides using 3M tetramethyl ammonium chloride wherein the melting point of the hybrid depends only on the length of the oligonucleotide probe, regardless of its GC content. In addition, Drmanac et al. (supra) describe hybridization conditions that allow stringent hybridization of 6-10 nucleotide long oligomers, and similar conditions may be obtained most readily by using nucleotide analogues such as 'locked nucleic acids (Christensen et al., 2001 *Biochem J* 354: 481-4).

Generally, a hybridization reaction can be performed in the presence of a hybridization buffer that optionally includes a hybridization optimising agent, such as an isostabilising agent, a denaturing agent and/or a renaturation accelerant. Examples of isostabilising agents include, but are not restricted to, betaines and lower tetraalkyl ammonium salts.

Denaturing agents are compositions that lower the melting temperature of double stranded nucleic acid molecules by interfering with hydrogen bonding between bases in a double stranded nucleic acid or the hydration of nucleic acid molecules. Denaturing agents include, but are not restricted to, formamide, formaldehyde, dimethylsulphoxide, tetraethyl acetate, urea, guanidium isothiocyanate, glycerol and chaotropic salts. Hybridization accelerants include heterogeneous nuclear ribonucleoprotein (hnRP) A1 and cationic detergents such as cetyltrimethylammonium bromide (CTAB) and dodecyl trimethylammonium bromide (DTAB), polylysine, spermine, spermidine, single stranded binding protein (SSB), phage T4 gene 32 protein and a mixture of ammonium acetate and ethanol. Hybridization buffers may include target polynucleotides at a concentration between about 0.005 nM and about 50 mM, preferably between about 0.5 nM and 5 nM, more preferably between about 1 nM and 2 nM.

A hybridization mixture containing the target HVI marker polynucleotides is placed in contact with the array of probes and incubated at a temperature and for a time appropriate to permit hybridization between the target sequences in the target polynucleotides and any complementary probes. Contact can take place in any suitable container, for example, a dish or a cell designed to hold the solid support on which the probes are bound. Generally, incubation will be at temperatures normally used for hybridization of nucleic acids, for example, between about 20° C. and about 75° C., example, about 25° C., about 30° C., about 35° C., about 40° C., about 45° C., about 50° C., about 55° C., about 60° C., or about 65° C. For probes longer than 14 nucleotides, 20° C. to 50° C. is desirable. For shorter probes, lower temperatures are preferred. A sample of target polynucleotides is incubated with the probes for a time sufficient to allow the desired level of hybridization between the target sequences in the target polynucleotides and any complementary probes. For example, the hybridization may be carried out at about 45° C.+/−10° C. in formamide for 1-2 days.

After the hybrid-forming step, the probes are washed to remove any unbound nucleic acid with a hybridization buffer, which can typically comprise a hybridization optimising agent in the same range of concentrations as for the hybridization step. This washing step leaves only bound target polynucleotides. The probes are then examined to identify which probes have hybridized to a target polynucleotide.

The hybridization reactions are then detected to determine which of the probes has hybridized to a corresponding target sequence. Depending on the nature of the reporter molecule associated with a target polynucleotide, a signal may be instrumentally detected by irradiating a fluorescent label with light and detecting fluorescence in a fluorimeter; by providing for an enzyme system to produce a dye which could be detected using a spectrophotometer; or detection of a dye particle or a colored colloidal metallic or non metallic particle using a reflectometer; in the case of using a radioactive label or chemiluminescent molecule employing a radiation counter or autoradiography. Accordingly, a detection means may be adapted to detect or scan light associated with the label which light may include fluorescent, luminescent, focussed beam or laser light. In such a case, a charge couple device (CCD) or a photocell can be used to scan for emission of light from a probe:target polynucleotide hybrid from each location in the micro-array and record the data directly in a digital computer. In some cases, electronic detection of the signal may not be necessary. For example, with enzymatically generated color spots associated with nucleic acid array format, visual examination of the array will allow interpretation of the pattern on the array. In the case of a nucleic acid array, the detection means is suitably interfaced with pattern recognition software to convert the pattern of signals from the array into a plain language genetic profile. In certain embodiments, oligonucleotide probes specific for different HVI marker gene products are in the form of a nucleic acid array and detection of a signal generated from a reporter molecule on the array is performed using a 'chip reader'. A detection system that can be used by a 'chip reader' is described for example by Pirrung et al (U.S. Pat. No. 5,143,854). The chip reader will typically also incorporate some signal processing to determine whether the signal at a particular array position or feature is a true positive or maybe a spurious signal. Exemplary chip readers are described for example by Fodor et al (U.S. Pat. No. 5,925,525). Alternatively, when the array is made using a mixture of individually addressable kinds of labeled microbeads, the reaction may be detected using flow cytometry.

5.2 Protein-Based Diagnostics

Consistent with the present invention, the presence of an aberrant concentration of an HVI marker protein is indicative of the presence, degree or stage of herpes virus infection, especially active herpes virus infection or risk of development of herpes virus sequelae. HVI marker protein levels in biological samples can be assayed using any suitable method known in the art. For example, when an HVI marker protein is an enzyme, the protein can be quantified based upon its catalytic activity or based upon the number of molecules of the protein contained in a sample. Antibody-based techniques may be employed, such as, for example, immunohistological and immunohistochemical methods for measuring the level of a protein of interest in a tissue sample. For example, specific recognition is provided by a primary antibody (polyclonal or monoclonal) and a secondary detection system is used to detect presence (or binding) of the primary antibody. Detectable labels can be conjugated to the secondary antibody, such as a fluorescent label, a radiolabel, or an enzyme (e.g., alkaline phosphatase, horseradish peroxidase) which produces a quantifiable, e.g., colored, product. In another suitable method, the primary antibody itself can be detectably labeled. As a result, immunohistological labeling of a tissue section is provided. In some embodiments, a protein extract is produced from a biological sample (e.g., tissue, cells) for analysis. Such an extract (e.g., a detergent extract) can be subjected to western-blot or dot/slot assay of the level of the protein of interest, using routine immunoblotting methods (Jalkanen et al., 1985, *J. Cell. Biol.* 101: 976-985; Jalkanen et al., 1987, *J. Cell. Biol.* 105: 3087-3096).

Other useful antibody-based methods include immunoassays, such as the enzyme-linked immunosorbent assay (ELISA) and the radioimmunoassay (RIA). For example, a protein-specific monoclonal antibody, can be used both as an immunoadsorbent and as an enzyme-labeled probe to detect and quantify an HVI marker protein of interest. The amount of such protein present in a sample can be calculated by reference to the amount present in a standard preparation using a linear regression computer algorithm (see Lacobilli et al., 1988, *Breast Cancer Research and Treatment* 11: 19-30). In other embodiments, two different monoclonal antibodies to the protein of interest can be employed, one as the immunoadsorbent and the other as an enzyme-labeled probe.

Additionally, recent developments in the field of protein capture arrays permit the simultaneous detection and/or quantification of a large number of proteins. For example, low-density protein arrays on filter membranes, such as the universal protein array system (Ge, 2000 *Nucleic Acids Res.* 28 (2):e3) allow imaging of arrayed antigens using standard ELISA techniques and a scanning charge-coupled device (CCD) detector. Immuno-sensor arrays have also been developed that enable the simultaneous detection of clinical analytes. It is now possible using protein arrays, to profile protein expression in bodily fluids, such as in sera of healthy or diseased subjects, as well as in subjects pre- and post-drug treatment.

Protein capture arrays typically comprise a plurality of protein-capture agents each of which defines a spatially distinct feature of the array. The protein-capture agent can be any molecule or complex of molecules which has the ability to bind a protein and immobilise it to the site of the protein-capture agent on the array. The protein-capture agent may be a protein whose natural function in a cell is to specifically bind another protein, such as an antibody or a receptor. Alternatively, the protein-capture agent may instead be a partially or wholly synthetic or recombinant protein which specifically binds a protein. Alternatively, the protein-capture agent may be a protein which has been selected in vitro from a mutagenized, randomized, or completely random and synthetic library by its binding affinity to a specific protein or peptide target. The selection method used may optionally have been a display method such as ribosome display or phage display, as known in the art. Alternatively, the protein-capture agent obtained via in vitro selection may be a DNA or RNA aptamer which specifically binds a protein target (see, e.g., Potyrailo et al., 1998 *Anal. Chem.* 70:3419-3425; Cohen et al., 1998, *Proc. Natl. Acad. Sci. USA* 95:14272-14277; Fukuda, et al., 1997 *Nucleic Acids Symp. Ser.* 37:237-238; available from SomaLogic). For example, aptamers are selected from libraries of oligonucleotides by the Selex™ process and their interaction with protein can be enhanced by covalent attachment, through incorporation of brominated deoxyuridine and UV-activated crosslinking (photoaptamers). Aptamers have the advantages of ease of production by automated oligonucleotide synthesis and the stability and robustness of DNA; universal fluorescent protein stains can be used to detect binding. Alternatively, the in vitro selected protein-capture agent may be a polypeptide (e.g., an antigen) (see, e.g., Roberts and Szostak, 1997 *Proc. Natl. Acad. Sci. USA*, 94:12297-12302).

An alternative to an array of capture molecules is one made through 'molecular imprinting' technology, in which peptides (e.g., from the C-terminal regions of proteins) are used as templates to generate structurally complementary, sequence-specific cavities in a polymerizable matrix; the cavities can then specifically capture (denatured) proteins which have the appropriate primary amino acid sequence (e.g., available from ProteinPrint™ and Aspira Biosystems).

Exemplary protein capture arrays include arrays comprising spatially addressed antigen-binding molecules, commonly referred to as antibody arrays, which can facilitate extensive parallel analysis of numerous proteins defining a proteome or subproteome. Antibody arrays have been shown to have the required properties of specificity and acceptable background, and some are available commercially (e.g., BD Biosciences, Clontech, BioRad and Sigma). Various methods for the preparation of antibody arrays have been reported (see, e.g., Lopez et al., 2003 *J. Chromatogr. B* 787:19-27; Cahill, 2000 *Trends in Biotechnology* 7:47-51; U.S. Pat. App. Pub. 2002/0055186; U.S. Pat. App. Pub. 2003/0003599; PCT publication WO 03/062444; PCT publication WO 03/077851; PCT publication WO 02/59601; PCT publication WO 02/39120; PCT publication WO 01/79849; PCT publication WO 99/39210). The antigen-binding molecules of such arrays may recognise at least a subset of proteins expressed by a cell or population of cells, illustrative examples of which include growth factor receptors, hormone receptors, neurotransmitter receptors, catecholamine receptors, amino acid derivative receptors, cytokine receptors, extracellular matrix receptors, antibodies, lectins, cytokines, serpins, proteases, kinases, phosphatases, ras-like GTPases, hydrolases, steroid hormone receptors, transcription factors, heat-shock transcription factors, DNA-binding proteins, zinc-finger proteins, leucine-zipper proteins, homeodomain proteins, intracellular signal transduction modulators and effectors, apoptosis-related factors, DNA synthesis factors, DNA repair factors, DNA recombination factors, cell-surface antigens, hepatitis C virus (HCV) proteases and HIV proteases.

Antigen-binding molecules for antibody arrays are made either by conventional immunisation (e.g., polyclonal sera and hybridomas), or as recombinant fragments, usually expressed in *E. coli*, after selection from phage display or ribosome display libraries (e.g., available from Cambridge Antibody Technology, BioInvent, Affitech and Biosite). Alternatively, 'combibodies' comprising non-covalent associations of VH and VL domains, can be produced in a matrix format created from combinations of diabody-producing bacterial clones (e.g., available from Domantis). Exemplary antigen-binding molecules for use as protein-capture agents include monoclonal antibodies, polyclonal antibodies, Fv, Fab, Fab' and F(ab')$_2$ immunoglobulin fragments, synthetic stabilized Fv fragments, e.g., single chain Fv fragments (scFv), disulfide stabilized Fv fragments (dsFv), single variable region domains (dAbs) minibodies, combibodies and multivalent antibodies such as diabodies and multi-scFv, single domains from camelids or engineered human equivalents.

Individual spatially distinct protein-capture agents are typically attached to a support surface, which is generally planar or contoured. Common physical supports include glass slides, silicon, microwells, nitrocellulose or PVDF membranes, and magnetic and other microbeads.

While microdrops of protein delivered onto planar surfaces are widely used, related alternative architectures include CD centrifugation devices based on developments in microfluidics (e.g., available from Gyros) and specialized chip designs, such as engineered microchannels in a plate (e.g., The Living Chip™, available from Biotrove) and tiny 3D posts on a silicon surface (e.g., available from Zyomyx).

Particles in suspension can also be used as the basis of arrays, providing they are coded for identification; systems include color coding for microbeads (e.g., available from Luminex, Bio-Rad and Nanomics Biosystems) and semiconductor nanocrystals (e.g., QDots™, available from Quantum Dots), and barcoding for beads (UltraPlex™, available from Smartbeads) and multimetal microrods (Nanobarcodes™ particles, available from Surromed). Beads can also be assembled into planar arrays on semiconductor chips (e.g., available from LEAPS technology and BioArray Solutions). Where particles are used, individual protein-capture agents are typically attached to an individual particle to provide the spatial definition or separation of the array. The particles may then be assayed separately, but in parallel, in a compartmentalized way, for example in the wells of a microtitre plate or in separate test tubes.

In operation, a protein sample, which is optionally fragmented to form peptide fragments (see, e.g., U.S. Pat. App. Pub. 2002/0055186), is delivered to a protein-capture array under conditions suitable for protein or peptide binding, and the array is washed to remove unbound or non-specifically bound components of the sample from the array. Next, the presence or amount of protein or peptide bound to each feature of the array is detected using a suitable detection system. The amount of protein bound to a feature of the array may be determined relative to the amount of a second protein bound to a second feature of the array. In certain embodiments, the amount of the second protein in the sample is already known or known to be invariant.

For analysing differential expression of proteins between two cells or cell populations, a protein sample of a first cell or population of cells is delivered to the array under conditions suitable for protein binding. In an analogous manner, a protein sample of a second cell or population of cells to a second array, is delivered to a second array which is identical to the first array. Both arrays are then washed to remove unbound or non-specifically bound components of the sample from the arrays. In a final step, the amounts of protein remaining bound to the features of the first array are compared to the amounts of protein remaining bound to the corresponding features of the second array. To determine the differential protein expression pattern of the two cells or populations of cells, the amount of protein bound to individual features of the first array is subtracted from the amount of protein bound to the corresponding features of the second array.

In an illustrative example, fluorescence labeling can be used for detecting protein bound to the array. The same instrumentation as used for reading DNA microarrays is applicable to protein-capture arrays. For differential display, capture arrays (e.g. antibody arrays) can be probed with fluorescently labeled proteins from two different cell states, in which cell lysates are labeled with different fluorophores (e.g., Cy-3 and Cy-5) and mixed, such that the color acts as a readout for changes in target abundance. Fluorescent readout sensitivity can be amplified 10-100 fold by tyramide signal amplification (TSA) (e.g., available from PerkinElmer Lifesciences). Planar waveguide technology (e.g., available from Zeptosens) enables ultrasensitive fluorescence detection, with the additional advantage of no washing procedures. High sensitivity can also be achieved with suspension beads and particles, using phycoerythrin as label (e.g., available from Luminex) or the properties of semiconductor nanocrystals (e.g., available from Quantum Dot). Fluorescence resonance energy transfer has been adapted to detect binding of unlabeled ligands, which may be useful on arrays (e.g., available from Affibody). Several alternative readouts have been developed, including adaptations of surface plasmon resonance (e.g., available from HTS Biosystems and Intrinsic Bioprobes), rolling circle DNA amplification (e.g., available from Molecular Staging), mass spectrometry (e.g., available from Sense Proteomic, Ciphergen, Intrinsic and Bioprobes), resonance light scattering (e.g., available from Genicon Sciences) and atomic force microscopy (e.g., available from BioForce Laboratories). A microfluidics system for automated sample incubation with arrays on glass slides and washing has been co-developed by NextGen and Perkin Elmer Life Sciences.

In certain embodiments, the techniques used for detection of HVI marker expression products will include internal or external standards to permit quantitative or semi-quantitative determination of those products, to thereby enable a valid comparison of the level or functional activity of these expression products in a biological sample with the corresponding expression products in a reference sample or samples. Such standards can be determined by the skilled practitioner using standard protocols. In specific examples, absolute values for the level or functional activity of individual expression products are determined.

In specific embodiments, the diagnostic method is implemented using a system as disclosed, for example, in International Publication No. WO 02/090579 and in copending PCT Application No. PCT/AU03/01517 filed Nov. 14, 2003, comprising at least one end station coupled to a base station. The base station is typically coupled to one or more databases comprising predetermined data from a number of individuals representing the level or functional activity of HVI marker expression products, together with indications of the actual status of the individuals (e.g., presence, absence, degree, stage of herpes virus infection or risk of development of herpes virus sequelae) when the predetermined data was collected. In operation, the base station is adapted to receive from the end station, typically via a communications network, subject data representing a measured or normalized level or functional activity of at least one expression product in a biological sample obtained from a test subject and to compare the subject data to the predetermined data stored in the database(s). Comparing the subject and predetermined data allows the base station to determine the status of the subject in accordance with the results of the comparison. Thus, the base station attempts to identify individuals having similar parameter values to the test subject and once the status has been determined on the basis of that identification, the base station provides an indication of the diagnosis to the end station.

5.3 Kits

All the essential materials and reagents required for detecting and quantifying HVI marker gene expression products may be assembled together in a kit. The kits may also optionally include appropriate reagents for detection of labels, positive and negative controls, washing solutions, blotting membranes, microtitre plates dilution buffers and the like. For example, a nucleic acid-based detection kit may include (i) an HVI marker polynucleotide (which may be used as a positive control), (ii) a primer or probe that specifically hybridizes to an HVI marker polynucleotide. Also included may be enzymes suitable for amplifying nucleic acids including various polymerases (Reverse Transcriptase, Taq, Sequenase™ DNA ligase etc. depending on the nucleic acid amplification technique employed), deoxynucleotides and buffers to provide the necessary reaction mixture for amplification. Such kits also generally will comprise, in suitable means, distinct containers for each individual reagent and enzyme as well as for each primer or probe. Alternatively, a protein-based detection kit may include (i) an HVI marker polypeptide (which may be used as a positive control), (ii) an antigen-binding molecule that is immuno-interactive with an HVI marker polynucleotide. The kit can also feature various devices and reagents for performing one of the assays described herein; and/or printed instructions for using the kit to quantify the expression of an HVI marker gene.

The kits may optionally include appropriate reagents for detection of labels, positive and negative controls, washing solutions, blotting membranes, microtitre plates dilution buffers and the like. For example, a nucleic acid-based detection kit may include (i) an HVI marker polynucleotide (which may be used as a positive control), (ii) a primer or probe that specifically hybridizes to an HVI marker polynucleotide. Also included may be enzymes suitable for amplifying nucleic acids including various polymerases (Reverse Transcriptase, Taq, Sequenase™ DNA ligase etc. depending on the nucleic acid amplification technique employed), deoxynucleotides and buffers to provide the necessary reaction mixture for amplification. Such kits also generally will comprise, in suitable means, distinct containers for each individual reagent and enzyme as well as for each primer or probe. Alternatively, a protein-based detection kit may include (i) an HVI marker polypeptide (which may be used as a positive control), (ii) an antigen-binding molecule that is immuno-interactive with an HVI marker polynucleotide. The kit can also feature various devices and reagents for performing one of the assays described herein; and/or printed instructions for using the kit to quantify the expression of an HVI marker polynucleotide.

6. Methods of Treatment or Prophylaxis

The present invention also extends to the treatment or prevention of herpes virus infection, especially active herpes virus infection, in subjects following positive diagnosis for the risk of development of herpes virus sequelae in the subjects. Generally, the treatment will include administering to a positively diagnosed subject an effective amount of an agent or therapy that ameliorates the symptoms or reverses the development of herpes virus infection, or that reduces the potential of the subject to developing herpes virus sequelae. Current agents suitable for treating herpes virus infections include, but are not limited to, acyclovir, famcyclovir, valacyclovir, gancyclovir, pencyclovir, azidothymidine, cytidine arabinoside, ribavirin, amantadine, iododeoxyuridine, poscarnet, trifluoridine, methizazone, vidarabine, levanisole 4-amino-α,α-dimethyl-2-ethoxymethyl-1H-imidazo[4,5-c]quinoline-1-ethanol as disclosed, for example, in U.S. Patent Application Publication No. 20020147210, hydroxylated tolans as disclosed, for example, in U.S. Patent Application Publication No. 20020103262, cyclopropanated carbocyclic 2'-deoxynucleosides as disclosed, for example, in U.S. Pat. No. 5,840,728, thymidine-analogous antiherpetic drugs as disclosed, for example, in U.S. Pat. No. 6,048,843, Foscarnet (PFA, Foscavir™ from Astra, Sodertlje, Sweden), 5-(E)-bromovinyl uracil analogues and related pyrimidine nucleosides as disclosed, for example, in U.S. Patent Application Publication No. 20040053891, 1-aryl-4-oxo-1,4-dihydro-3-quinolinecarboxamides as disclosed, for example, in U.S. Patent Application Publication No. 20040024209, and spermidine catecholamide iron chelators as disclosed, for example, by Raymond et al. (1984, *Biochem. Bioph. Res. Comm.*, 121 (3): 848-854).

Alternatively, the subject may be treated using an apparatus, as described for example in U.S. Patent Application Publication No. 20020099426, which delivers electrical stimulation to an infected skin or mucosa of a patient. The electrical stimulation is applied as a series of electrical pulses having different electrical characteristics.

However, it will be understood that the present invention encompasses any agent or process that is useful for treating or preventing a herpes virus infection and is not limited to the aforementioned illustrative compounds and formulations.

Typically, herpes virus infection-relieving agents will be administered in pharmaceutical (or veterinary) compositions together with a pharmaceutically acceptable carrier and in an effective amount to achieve their intended purpose. The dose of active compounds administered to a subject should be sufficient to achieve a beneficial response in the subject over time such as a reduction in, or relief from, the symptoms of herpes virus infection, especially active herpes virus infection. The quantity of the pharmaceutically active compounds(s) to be administered may depend on the subject to be treated inclusive of the age, sex, weight and general health condition thereof. In this regard, precise amounts of the active compound(s) for administration will depend on the judgement of the practitioner. In determining the effective amount of the active compound(s) to be administered in the treatment or prevention of herpes virus infection, the physician or veterinarian may evaluate severity of any symptom associated with the presence of herpes virus infection including symptoms related to herpes virus sequelae as mentioned above. In any event, those of skill in the art may readily determine suitable dosages of the herpes virus infection-relieving agents and suitable treatment regimens without undue experimentation.

In specific embodiments, the present invention extends to the management of EHV infection, management of relapse of EHV infection, or prevention of further infection of EHV in subjects following positive diagnosis for the presence, or stage of EHV in the subjects. Generally, the management includes isolation to prevent further infection, palliative therapies, and rest to avoid long-term damage. The present invention permits more effective quarantine and management decisions to be made at a time when the animal is infective—veterinarians, owners and trainers armed with this information would be able to isolate these animals until viral shedding had stopped to prevent infection of other horses, especially other pregnant mares. By contrast, prior art methods merely enable the diagnosis of EHV only after the infectious stage has passed—and are therefore not useful for quarantine decisions.

In order that the invention may be readily understood and put into practical effect, particular preferred embodiments will now be described by way of the following non-limiting examples.

EXAMPLES

Example 1

Identification of Specific Diagnostic Genes for Herpes Virus Infection

Experimental Disease Trial Design

Equine Herpes Virus 1 (EHV-1) infection was induced in thirteen (13) foals in two groups at separate times. Six foals were followed for 20 days and infected (experimentally inoculated) on day 0 (Group 1). Seven (7) foals were followed for 42 days and experimentally inoculated on day 21 (Group 2). All foals were infected with in vitro cultured EHV-1 using nasopharyngeal aerosol. Blood samples from Group 1 were taken at eight time points—Days 0, 1, 2, 4, 6, 10, 13 and 20. Blood samples from Group 2 were taken at 16 time points, days 0, 1, 2, 4, 6, 10, 13, 20, 21, 22, 23, 25, 27, 31, 34 and 41. The sample at Day 0 acted as a control for each horse.

Animals in Group 2 were subsequently discovered to have been subjected to natural and unsynchronized infection with EHV. All animals in Group 2 seroconverted, and the time of seroconversion was used to impute a time of natural infection (some 10-14 days before seroconversion). Because infection times in Group 2 were not synchronized, gene expression data from these animals were used to test the diagnostic signatures developed using Group 1.

The following tests and observations were undertaken at all of the above time points:
Physical examination, including temperature, pulse and respiration measurements
Haematology and biochemistry
PCR on nasal swabs
Serum EHV-1 antibody (Ab) titres
Gene expression analysis on a white blood cell specific gene array.

Blood samples obtained from exposed animals were analyzed using GeneChips™ (method of use is described below in detail in "Generation of Gene Expression Data") containing thousands of genes expressed in white blood cells of horses. Analysis of these data (see "Identification of Responding Genes and Demonstration of Diagnostic Potential" below) reveal a number of specific genes that differ in expression between animals before and after infection with EHV from day 1 following infection. It is possible to design an assay that measures the RNA level in the sample from the expression of at least one and desirably at least two HVI marker genes representative transcript sequences of which are set forth in 1, 2, 4, 6, 7, 8, 10, 12, 13, 15, 17, 19, 21, 23, 24, 25, 26, 27, 29, 31, 33, 34, 35, 37, 38, 39, 41, 43, 45, 47, 49, 51, 53, 55, 57, 59, 61, 63, 65, 66, 67, 69, 71, 73, 75, 76, 77, 79, 81, 83, 84, 85, 87, 89, 91, 93, 94, 96, 98, 99, 100, 101, 102, 104, 106, 107, 108, 109, 111 or 113. This provides a level of specificity and sensitivity both equal to 94%. Alternatively, any combination of at least two polynucleotides with any of the other 61 HVI marker polynucleotides listed in Table 1 provides strong diagnostic capacity.

Materials and Methods

Blood Collection

Blood is collected from a horse (in a non-agitated state) for the purpose of extraction of high quality RNA or protein. Suitable blood collection tubes for the collection, preservation, transport and isolation of RNA include PAXgene™ tubes (PreAnalytix Inc., Valencia, Calif., USA). Alternatively, blood can be collected into tubes containing solutions designed for the preservation of nucleic acids (available from Roche, Ambion, Invitrogen and ABI). For the determination of protein levels, 50 mL of blood is prevented from clotting by collection into a tube containing 4 mL of 4% sodium citrate. White blood cells and plasma are isolated and stored frozen for later analysis and detection of specific proteins. PAXgene tubes can be kept at room temperature prior to RNA extraction. Clinical signs are recorded in a standard format.

A kit available from Qiagen Inc (Valencia, Calif., USA) has the reagents and instructions for the isolation of total RNA from 2.5 mL blood collected in the PAXgene Blood RNA Tube. Isolation begins with a centrifugation step to pellet nucleic acids in the PAXgene blood RNA tube. The pellet is washed and resuspended and incubated in optimized buffers together with Proteinase K to bring about protein digestion. An additional centrifugation is carried out to remove residual cell debris and the supernatant is transferred to a fresh microcentrifuge tube. Ethanol is added to adjust binding conditions, and the lysate is applied to the PAXgene RNA spin column. During brief centrifugation, RNA is selectively bound to the silica-gel membrane as contaminants pass through. Remaining contaminants are removed in three efficient wash steps and RNA is then eluted in Buffer BR5.

Determination of RNA quantity and quality is necessary prior to proceeding and can be achieved using an Agilent Bioanalyzer and Absorbance 260/280 ratio using a spectrophotometer.

DNA Extraction

A kit available from Qiagen Inc (Valencia, Calif., USA) has the reagents and instructions for the isolation of total DNA from 8.5 mL blood collected in the PAXgene Blood DNA Tube. Isolation begins with the addition of additional lysis solution followed by a centrifugation step. The pellet is washed and resuspended and incubated in optimized buffers together with Proteinase K to bring about protein digestion. DNA is precipitated using alcohol and an additional centrifugation is carried out to pellet the nucleic acid. Remaining contaminants are removed in a wash step and the DNA is then resuspended in Buffer BG4.

Determination of DNA quantity and quality is necessary prior to proceeding and can be achieved using a spectrophotometer or agarose gel electrophoresis.

Serum Antibody Determination

Serum antibody levels to EHV-1 were determined by ELISA assay using recombinant EHV-1 glycoprotein G essentially as described by Foote et al. (Equine Vet J. 36 (4): 341-345, 2004). Total RNA Extraction Generation of Gene Expression Data Choice of Method Measurement of specific RNA levels in a tissue sample can be achieved using a variety of technologies. Two common and readily available technologies that are well known in the art are:
  GeneChip™ analysis using Affymetrix technology.
  Real-Time Polymerase Chain Reaction (TaqMan™ from Applied Biosystems for example).

GeneChips™ quantitate RNA by detection of labeled cRNA hybridized to short oligonucleotides built on a silicon substrate. Details on the technology and methodology can be found at www.affymetrix.com.

Real-Time Polymerase Chain Reaction (RT-PCR) quantitates RNA using two PCR primers, a labeled probe and a thermostable DNA polymerase. As PCR product is generated a dye is released into solution and detected. Internal controls such as 18S RNA probes are often used to determine starting levels of total RNA in the sample. Each gene and the internal control are run separately. Details on the technology and methods can be found at www.appliedbiosystems.com or www.qiagen.com or www.biorad.com. Applied Biosystems offer a service whereby the customer provides DNA sequence information and payment and is supplied in return all of the reagents required to perform RT-PCR analysis on individual genes.

GeneChip™ analysis has the advantage of being able to analyze thousands of genes at a time. However it is expensive and takes over 3 days to perform a single assay. RT-PCR generally only analyzes one gene at a time, but is inexpensive and can be completed within a single day.

RT-PCR is the method of choice for gene expression analysis if the number of specific genes to be analyzed is less than 20. GeneChip™ or other gene expression analysis technologies (such as Illumina Bead Arrays) are the method of choice when many genes need to be analyzed simultaneously.

The methodology for GeneChip™ data generation and analysis and Real Time PCR is presented below in brief.

GeneChip™ Data Generation cDNA & cRNA Generation:

The following method for cDNA and cRNA generation from total RNA has been adapted from the protocol provided and recommended by Affymetrix (www.affymetrix.com).

The steps are:

- A total of 3 μg of total RNA is used as a template to generate double stranded cDNA.
- cRNA is generated and labeled using biotinylated Uracil (dUTP).
- biotin-labeled cRNA is cleaned and the quantity determined using a spectrophotometer and MOPS gel analysis.
- labeled cRNA is fragmented to ~300 bp in size.
- RNA quantity is determined on an Agilent "Lab-on-a-Chip" system (Agilent Technologies).

Hybridization, Washing & Staining:

The steps are:

A hybridization cocktail is prepared containing 0.05 µg/µL of labeled and fragmented cRNA, spike-in positive hybridization controls, and the Affymetrix oligonucleotides B2, bioB, bioC, bioD and cre.

The final volume (80 µL) of the hybridization cocktail is added to the GeneChip™ cartridge.

The cartridge is placed in a hybridization oven at constant rotation for 16 hours.

The fluid is removed from the GeneChip™ and stored.

The GeneChip™ is placed in the fluidics station.

The experimental conditions for each GeneChip™ are recorded as an .EXP file.

All washing and staining procedures are carried out by the Affymetrix fluidics station with an attendant providing the appropriate solutions.

The GeneChip™ is washed, stained with steptavidin-phycoerythin dye and then washed again using low salt solutions.

After the wash protocols are completed, the dye on the probe array is 'excited' by laser and the image captured by a CCD camera using an Affymetrix Scanner (manufactured by Agilent).

Scanning & Data File Generation:

The scanner and MAS 5 software generates an image file from a single GeneChip☐ called a .DAT file (see figure overleaf).

The .DAT file is then pre-processed prior to any statistical analysis.

Data pre-processing steps (prior to any statistical analysis) include:

.DAT File Quality Control (QC).

.CEL File Generation.

Scaling and Normalization.

.DAT File Quality Control

The .DAT file is an image. The image is inspected manually for artifacts (e.g. high/low intensity spots, scratches, high regional or overall background). (The B2 oligonucleotide hybridization performance is easily identified by an alternating pattern of intensities creating a border and array name). The MAS 5 software used the B2 oligonucleotide border to align a grid over the image so that each square of oligonucleotides was centered and identified.

The other spiked hybridization controls (bioB, bioC, bioD and cre) are used to evaluate sample hybridization efficiency by reading "present" gene detection calls with increasing signal values, reflecting their relative concentrations. (If the .DAT file is of suitable quality it is converted to an intensity data file (.CEL file) by Affymetrix MAS 5 software).

.CEL File Generation

The .CEL files generated by the MAS 5 software from .DAT files contain calculated raw intensities for the probe sets. Gene expression data is obtained by subtracting a calculated background from each cell value. To eliminate negative intensity values, a noise correction fraction based from a local noise value from the standard deviation of the lowest 2% of the background is applied.

All .CEL files generated from the GeneChips™ are subjected to specific quality metrics parameters.

Some metrics are routinely recommended by Affymetrix and can be determined from Affymetrix internal controls provided as part of the GeneChip™. Other metrics are based on experience and the processing of many GeneChips™.

Analysis of GeneChip™ Data

Three illustrative approaches to normalizing data might be used:

Affymetrix MAS 5 Algorithm.

Robust Multi-chip Analysis (RMA) algorithm of Irizarry (Irizarray et al., 2002, Biostatistics (in print)).

Robust Multi-chip Analysis Saved model (RMAS).

Those of skill in the art will recognise that many other approaches might be adopted, without materially affecting the invention.

Affymetrix MAS 5 Algorithm

.CEL files are used by Affymetrix MAS 5 software to normalize or scale the data. Scaled data from one chip are compared to similarly scaled data from other chips.

Affymetrix MAS 5 normalization is achieved by applying the default "Global Scaling" option of the MAS 5 algorithm to the .CEL files. This procedure subtracts a robust estimate of the center of the distribution of probe values, and divides by a robust estimate of the probe variability. This produces a set of chips with common location and scale at the probe level.

Gene expression indices are generated by a robust averaging procedure on all the probe pairs for a given gene. The results are constrained to be non-negative.

Given that scaling takes place at the level of the probe, rather than at the level of the gene, it is possible that even after normalization there may be chip-to-chip differences in overall gene expression level. Following standard MAS5 normalization, values for each gene were de-trended with respect to median chip intensity. That is, values for each gene were regressed on the median chip intensity, and residuals were calculated. These residuals were taken as the de-trended estimates of expression for each gene Median chip intensity was calculated using the Affymetrix MAS5 algorithm, but with a scale factor fixed at one.

RMA Analysis

This method is identical to the RMA method, with the exception that probe weights and target quantiles are established using a long term library of chip .cel files, and are not re-calculated for these specific chips. Again, normalization occurs at the probe level.

Real-Time PCR Data Generation

Background information for conducting Real-time PCR may be obtained, for example, at http://dorakmt.tripod.com/genetics/realtime.html and in a review by Bustin SA (2000, J Mol Endocrinol 25:169-193).

TaqMan™ Primer and Probe Design Guidelines:

1. The Primer Express™ (ABI) software designs primers with a melting temperature (Tm) of 58-60☐C, and probes with a Tm value of 10° C. higher. The Tm of both primers should be equal;

2. Primers should be 15-30 bases in length;

3. The G+C content should ideally be 30-80%. If a higher G+C content is unavoidable, the use of high annealing and melting temperatures, cosolvents such as glycerol, DMSO, or 7-deaza-dGTP may be necessary;

4. The run of an identical nucleotide should be avoided. This is especially true for G, where runs of four or more Gs is not allowed;

5. The total number of Gs and Cs in the last five nucleotides at the 3' end of the primer should not exceed two (the newer version of the software has an option to do this automatically). This helps to introduce relative instability to the 3' end of primers to reduce non-specific priming. The primer conditions are the same for SYBR Green assays;

6. Maximum amplicon size should not exceed 400 bp (ideally 50-150 bases). Smaller amplicons give more consistent results because PCR is more efficient and more tolerant of reaction conditions (the short length requirement has nothing to do with the efficiency of 5' nuclease activity);

7. The probes should not have runs of identical nucleotides (especially four or more consecutive Gs), G+C content should be 30-80%, there should be more Cs than Gs, and not a G at the 5' end. The higher number of Cs produces a higher ΔRn. The choice of probe should be made first;

8. To avoid false-positive results due to amplification of contaminating genomic DNA in the cDNA preparation, it is preferable to have primers spanning exon-exon junctions. This way, genomic DNA will not be amplified (the PDAR kit for human GAPDH amplification has such primers);

9. If a TaqMan™ probe is designed for allelic discrimination, the mismatching nucleotide (the polymorphic site) should be in the middle of the probe rather than at the ends;

10. Use primers that contain dA nucleotides near the 3' ends so that any primer-dimer generated is efficiently degraded by AmpErase™ UNG (mentioned in p.9 of the manual for EZ RT-PCR kit; P/N 402877). If primers cannot be selected with dA nucleotides near the ends, the use of primers with 3' terminal dU-nucleotides should be considered.

(See also the general principles of PCR Primer Design by InVitroGen).

General Method:

1. Reverse transcription of total RNA to cDNA should be done with random hexamers (not with oligo-dT). If oligo-dT has to be used long mRNA transcripts or amplicons greater than two kilobases upstream should be avoided, and 18S RNA cannot be used as normalizer;

2. Multiplex PCR will only work properly if the control primers are limiting (ABI control reagents do not have their primers limited);

3. The range of target cDNA used is 10 ng to 1 □g. If DNA is used (mainly for allelic discrimination studies), the optimum amount is 100 ng to 1 □g;

4. It is ideal to treat each RNA preparation with RNAse free DNAse to avoid genomic DNA contamination. Even the best RNA extraction methods yield some genomic DNA. Of course, it is ideal to have primers not amplifying genomic DNA at all but sometimes this may not be possible;

5. For optimal results, the reagents (before the preparation of the PCR mix) and the PCR mixture itself (before loading) should be vortexed and mixed well. Otherwise there may be shifting Rn value during the early (0-5) cycles of PCR. It is also important to add probe to the buffer component and allow it to equilibrate at room temperature prior to reagent mix formulation.

TaqMan™ Primers and Probes:

The TaqMan™ probes ordered from ABI at midi-scale arrive already resuspended at 100 μM. If a 1/20 dilution is made, this gives a 5 μM solution. This stock solution should be aliquoted, frozen and kept in the dark. Using 1 μL of this in a 50 μL reaction gives the recommended 100 nM final concentration.

The primers arrive lyophilized with the amount given on the tube in pmols (such as 150.000 pmol which is equal to 150 nmol). If X nmol of primer is resuspended in X μL of H₂O, the resulting solution is 1 mM. It is best to freeze this stock solution in aliquots. When the 1 mM stock solution is diluted 1/100, the resulting working solution will be 10 μM. To get the recommended 50-900 nM final primer concentration in 50 μL reaction volume, 0.25-4.50 □L should be used per reaction (2.5 μL for 500 nM final concentration).

The PDAR primers and probes are supplied as a mix in one tube. They have to be used 2.5 μL in a 50 μL reaction volume.

Setting Up One-Step TaqMan™ Reaction:

One-step real-time PCR uses RNA (as opposed to cDNA) as a template. This is the preferred method if the RNA solution has a low concentration but only if singleplex reactions are run. The disadvantage is that RNA carryover prevention enzyme AmpErase cannot be used in one-step reaction format. In this method, both reverse transcriptase and real-time PCR take place in the same tube. The downstream PCR primer also acts as the primer for reverse transcriptase (random hexamers or oligo-dT cannot be used for reverse transcription in one-step RT-PCR). One-step reaction requires higher dNTP concentration (greater than or equal to 300 mM vs 200 mM) as it combines two reactions needing dNTPs in one. A typical reaction mix for one-step PCR by Gold RT-PCR kit is as follows:

| Reagents | Volume |
|---|---|
| H₂O + RNA: | 20.5 μL [24 μL if PDAR is used] |
| 10X TaqMan buffer: | 5.0 μL |
| MgCl2 (25 mM): | 11.0 μL |
| dATP (10 mM): | 1.5 μL [for final concentration of 300 μM] |
| dCTP (10 mM): | 1.5 μL [for final concentration of 300 μM] |
| dGTP (10 mM): | 1.5 μL [for final concentration of 300 μM] |
| dUTP (20 mM): | 1.5 μL [for final concentration of 600 μM] |
| Primer F (10 μM)*: | 2.5 μL [for final concentration of 500 nM] |
| Primer R (10 μM)*: | 2.5 μL [for final concentration of 500 nM] |
| TaqMan Probe*: | 1.0 μL [for final concentration of 100 nM] |
| AmpliTaq Gold: | 0.25 μL [can be increased for higher efficiency] |
| Reverse Transcriptase: | 0.25 μL |
| RNAse inhibitor: | 1.00 μL |

If a PDAR is used, 2.5 μL of primer+probe mix used.

Ideally 10 pg-100 ng RNA should be used in this reaction. Note that decreasing the amount of template from 100 ng to 50 ng will increase the CT value by 1. To decrease a CT value by 3, the initial amount of template should be increased 8-fold. ABI claims that 2 picograms of RNA can be detected by this system and the maximum amount of RNA that can be used is 1 microgram. For routine analysis, 10 pg-100 ng RNA and 100 pg-1 μg genomic DNA can be used.

Cycling Parameters for One-Step PCR:

Reverse transcription (by MuLV) 48° C. for 30 min.

AmpliTaq activation 95° C. for 10 min.

PCR: denaturation 95° C. for 15 sec and annealing/extension 60° C. for 1 min (repeated 40 times) (On ABI 7700, minimum holding time is 15 seconds).

The recently introduced EZ One-Step™ RT-PCR kit allows the use of UNG as the incubation time for reverse transcription is 60° C. thanks to the use of a thermostable reverse transcriptase. This temperature also a better option to avoid primer dimers and non-specific bindings at 48° C.

Operating the ABI 7700:

Make sure the following before starting a run:

1. Cycle parameters are correct for the run;

2. Choice of spectral compensation is correct (off for singleplex, on for multiplex reactions);

3. Choice of "Number of PCR Stages" is correct in the Analysis Options box (Analysis/Options). This may have to be manually assigned after a run if the data is absent in the amplification plot but visible in the plate view, and the X-axis of the amplification is displaying a range of 0-1 cycles;

4. No Template Control is labeled as such (for accurate ΔRn calculations);

5. The choice of dye component should be made correctly before data analysis;

6. You must save the run before it starts by giving it a name (not leaving as untitled);

7. Also at the end of the run, first save the data before starting to analyze.

The ABI software requires extreme caution. Do not attempt to stop a run after clicking on the Run button. You will have problems and if you need to switch off and on the machine, you have to wait for at least an hour to restart the run.

When analyzing the data, remember that the default setting for baseline is 3-15. If any CT value is <15, the baseline should be changed accordingly (the baseline stop value should be 1-2 smaller than the smallest CT value). For a useful discussion of this matter, see the ABI Tutorial on Setting Baselines and Thresholds. (Interestingly, this issue is best discussed in the manual for TaqMan™ Human Endogenous Control Plate).

If the results do not make sense, check the raw spectra for a possible CDC camera saturation during the run. Saturation of CDC camera may be prevented by using optical caps rather than optical adhesive cover. It is also more likely to happen when SYBR Green I is used, when multiplexing and when a high concentration of probe is used.

Interpretation of Results:

At the end of each reaction, the recorded fluorescence intensity is used for the following calculations:

Rn+ is the Rn value of a reaction containing all components, Rn− is the Rn value of an unreacted sample (baseline value or the value detected in NTC). ΔRn is the difference between Rn+ and Rn−. It is an indicator of the magnitude of the signal generated by the PCR.

There are three illustrative methods to quantitate the amount of template:

1. Absolute standard method: In this method, a known amount of standard such as in vitro translated RNA (cRNA) is used;

2. Relative standard: Known amounts of the target nucleic acid are included in the assay design in each run;

3. Comparative CT method: This method uses no known amount of standard but compares the relative amount of the target sequence to any of the reference values chosen and the result is given as relative to the reference value (such as the expression level of resting lymphocytes or a standard cell line).

The Comparative CT Method (ΔΔCT) for Relative Quantitation of Gene Expression:

This method enables relative quantitation of template and increases sample throughput by eliminating the need for standard curves when looking at expression levels relative to an active reference control (normalizer). For this method to be successful, the dynamic range of both the target and reference should be similar. A sensitive method to control this is to look at how ΔCT (the difference between the two CT values of two PCRs for the same initial template amount) varies with template dilution. If the efficiencies of the two amplicons are approximately equal, the plot of log input amount versus ΔCT will have a nearly horizontal line (a slope of <0.10). This means that both PCRs perform equally efficiently across the range of initial template amounts. If the plot shows unequal efficiency, the standard curve method should be used for quantitation of gene expression. The dynamic range should be determined for both (1) minimum and maximum concentrations of the targets for which the results are accurate and (2) minimum and maximum ratios of two gene quantities for which the results are accurate. In conventional competitive RT-PCR, the dynamic range is limited to a target-to-competitor ratio of about 10:1 to 1:10 (the best accuracy is obtained for 1:1 ratio). The real-time PCR is able to achieve a much wider dynamic range.

Running the target and endogenous control amplifications in separate tubes and using the standard curve method requires the least amount of optimisation and validation. The advantage of using the comparative CT method is that the need for a standard curve is eliminated (more wells are available for samples). It also eliminates the adverse effect of any dilution errors made in creating the standard curve samples.

As long as the target and normalizer have similar dynamic ranges, the comparative CT method (ΔΔCT method) is the most practical method. It is expected that the normalizer will have a higher expression level than the target (thus, a smaller CT value). The calculations for the quantitation start with getting the difference (ΔCT) between the CT values of the target and the normalizer:

$$\Delta CT = CT(\text{target}) - CT(\text{normalizer})$$

This value is calculated for each sample to be quantitated (unless, the target is expressed at a higher level than the normalizer, this should be a positive value. It is no harm if it is negative). One of these samples should be chosen as the reference (baseline) for each comparison to be made. The comparative ΔΔCT calculation involves finding the difference between each sample's ΔCT and the baseline's ΔCT. If the baseline value is representing the minimum level of expression, the ΔΔCT values are expected to be negative (because the ΔCT for the baseline sample will be the largest as it will have the greatest CT value). If the expression is increased in some samples and decreased in others, the ΔΔCT values will be a mixture of negative and positive ones. The last step in quantitation is to transform these values to absolute values. The formula for this is:

$$\text{comparative expression level} = 2^{-\Delta\Delta CT}$$

For expressions increased compared to the baseline level this will be something like $2^3 = 8$ times increase, and for decreased expression it will be something like $2^{-3} = \frac{1}{8}$ of the reference level. Microsoft Excel can be used to do these calculations by simply entering the CT values (there is an online ABI tutorial at http://www.appliedbiosystems.com/support/tutorials/7700 amp/ on the use of spread sheet programs to produce amplification plots; the TaqMan™ Human Endogenous Control Plate protocol also contains detailed instructions on using MS Excel for real-time PCR data analysis).

The other (absolute) quantification methods are outlined in the ABI User Bulletins (http://docs.appliedbiosystems.com/search.taf?_UserReference=A8658327189850A13A0C598E). The Bulletins #2 and #5 are most useful for the general understanding of real-time PCR and quantification.

Recommendations on Procedures:

1. Use positive-displacement pipettes to avoid inaccuracies in pipetting;

2. The sensitivity of real-time PCR allows detection of the target in 2 pg of total RNA. The number of copies of total RNA used in the reaction should ideally be enough to give a signal by 25-30 cycles (preferably less than 100 ng). The amount used should be decreased or increased to achieve this;

3. The optimal concentrations of the reagents are as follows;

i. Magnesium chloride concentration should be between 4 and 7 mM. It is optimized as 5.5 mM for the primers/probes designed using the Primer Express software;

ii. Concentrations of dNTPs should be balanced with the exception of dUTP (if used). Substitution of dUTP for dTTP for control of PCR product carryover requires twice dUTP that of other dNTPs. While the optimal range for dNTPs is 500 μM to 1 mM (for one-step RT-PCR), for a typical TaqMan reaction (PCR only), 200 μM of each dNTP (400 μM of dUTP) is used;

iii. Typically 0.25 μL (1.25 U) AmpliTaq DNA Polymerase (5.0 U/μL) is added into each 50 μL reaction. This is the minimum requirement. If necessary, optimisation can be done by increasing this amount by 0.25 U increments;

iv. The optimal probe concentration is 50-200 nM, and the primer concentration is 100-900 nM. Ideally, each primer pair should be optimized at three different temperatures (58, 60 and 62° C for TaqMan primers) and at each combination of three concentrations (50, 300, 900 nM). This means setting up three different sets (for three temperatures) with nine reactions in each (50/50 mM, 50/300 mM, 50/900, 300/50, 300/300, 300/900, 900/50, 900/300, 900/900 mM) using a fixed amount of target template. If necessary, a second round of optimisation may improve the results. Optimal performance is achieved by selecting the primer concentrations that provide the lowest CT and highest ΔRn. Similarly, the probe concentration should be optimized for 25-225 nM;

4. If AmpliTaq Gold DNA Polymerase is being used, there has to be a 9-12 min pre-PCR heat step at 92-95° C. to activate it. If AmpliTaq Gold DNA Polymerase is used, there is no need to set up the reaction on ice. A typical TaqMan reaction consists of 2 min at 50° C. for UNG (see below) incubation, 10 min at 95° C. for Polymerase activation, and 40 cycles of 15 sec at 95° C. (denaturation) and 1 min at 60° C. (annealing and extension). A typical reverse transcription cycle (for cDNA synthesis), which should precede the TaqMan reaction if the starting material is total RNA, consists of 10 min at 25° 0 C (primer incubation), 30 min at 48° C. (reverse transcription with conventional reverse transcriptase) and 5 min at 95° C. (reverse transcriptase inactivation);

5. AmpErase uracil-N-glycosylase (UNG) is added in the reaction to prevent the reamplification of carry-over PCR products by removing any uracil incorporated into amplicons. This is why dUTP is used rather than dTTP in PCR reaction. UNG does not function above 55° C. and does not cut single-stranded DNA with terminal dU nucleotides. UNG-containing master mix should not be used with one-step RT-PCR unless rTth DNA polymerase is being used for reverse transcription and PCR (TaqMan EZ RT-PCR kit);

6. It is necessary to include at least three No Amplification Controls (NAC) as well as three No Template Controls (NTC) in each reaction plate (to achieve a 99.7% confidence level in the definition of +/− thresholds for the target amplification, six replicates of NTCs must be run). NAC former contains sample and no enzyme. It is necessary to rule out the presence of fluorescence contaminants in the sample or in the heat block of the thermal cycler (these would cause false positives). If the absolute fluorescence of the NAC is greater than that of the NTC after PCR, fluorescent contaminants may be present in the sample or in the heating block of the thermal cycler;

7. The dynamic range of a primer/probe system and its normalizer should be examined if the ΔΔCT method is going to be used for relative quantitation. This is done by running (in triplicate) reactions of five RNA concentrations (for example, 0, 80 pg/μL, 400 pg/μL, 2 ng/μL and 50 ng/μL). The resulting plot of log of the initial amount vs CT values (standard curve) should be a (near) straight line for both the target and normalizer real-time RT-PCRs for the same range of total RNA concentrations;

8. The passive reference is a dye (ROX) included in the reaction (present in the TaqMan universal PCR master mix). It does not participate in the 5' nuclease reaction. It provides an internal reference for background fluorescence emission. This is used to normalize the reporter-dye signal. This normalization is for non-PCR-related fluorescence fluctuations occurring well-to-well (concentration or volume differences) or over time and different from the normalization for the amount of cDNA or efficiency of the PCR. Normalization is achieved by dividing the emission intensity of reporter dye by the emission intensity of the passive reference. This gives the ratio defined as Rn;

9. If multiplexing is done, the more abundant of the targets will use up all the ingredients of the reaction before the other target gets a chance to amplify. To avoid this, the primer concentrations for the more abundant target should be limited;

10. TaqMan Universal PCR master mix should be stored at 2 to 8° C. (not at −20° C.);

11. The GAPDH probe supplied with the TaqMan Gold RT-PCR kit is labeled with a JOE reporter dye, the same probe provided within the Pre-Developed TaqMan™ Assay Reagents (PDAR) kit is labeled with VIC. Primers for these human GAPDH assays are designed not to amplify genomic DNA;

12. The carryover prevention enzyme, AmpErase UNG, cannot be used with one-step RT-PCR which requires incubation at 48° C. but may be used with the EZ RT-PCR kit;

13. One-step RT-PCR can only be used for singleplex reactions, and the only choice for reverse transcription is the downstream primer (not random hexamers or oligo-dT);

14. It is ideal to run duplicates to control pipetting errors but this inevitably increases the cost;

15. If multiplexing, the spectral compensation option (in Advanced Options) should be checked before the run;

16. Normalization for the fluorescent fluctuation by using a passive reference (ROX) in the reaction and for the amount of cDNA/PCR efficiency by using an endogenous control (such as GAPDH, active reference) are different processes;

17. ABI 7700 can be used not only for quantitative RT-PCR but also end-point PCR. The latter includes presence/absence assays or allelic discrimination assays (such as SNP typing);

18. Shifting Rn values during the early cycles (cycle 0-5) of PCR means initial disequilibrium of the reaction components and does not affect the final results as long as the lower value of baseline range is reset;

19. If an abnormal amplification plot has been noted (CT value <15 cycles with amplification signal detected in early cycles), the upper value of the baseline range should be lowered and the samples should be diluted to increase the CT value (a high CT value may also be due to contamination);

20. A small ΔRn value (or greater than expected CT value) indicates either poor PCR efficiency or low copy number of the target;

21. A standard deviation >0.16 for CT value indicates inaccurate pipetting;

22. SYBR Green entry in the Pure Dye Setup should be abbreviated as "SYBR" in capitals. Any other abbreviation or lower case letters will cause problems;

23. The SDS software for ABI 7700 have conflicts with the Macintosh Operating System version 8.1. The data should not be analyzed on such computers;

24. The ABI 7700 should not be deactivated for extended periods of time. If it has ever been shutdown, it should be allowed to warm up for at least one hour before a run. Leaving the instrument on all times is recommended and is beneficial for the laser. If the machine has been switched on just before a run, an error box stating a firmware version conflict may appear. If this happens, choose the "Auto Download" option;

25. The ABI 7700 is only one of the real-time PCR systems available, others include systems from BioRad, Cepheid, Corbett Research, Roche and Stratagene.

Genotyping Analysis

Many methods are available to genotype DNA. A review of allelic discrimination methods can be found in Kristensen et al. (Biotechniques 30 (2):318-322 (2001). Only one method, allele-specific PCR is described here.

Primer Design

Upstream and downstream PCR primers specific for particular alleles can be designed using freely available computer programs, such as Primer3 (http://frodo.wi.mit.edu/primer3/primer3 code.html). Alternatively the DNA sequences of the various alleles can be aligned using a program such as ClustalW (http://www.ebi.ac.uk/clustalw/) and specific primers designed to areas where DNA sequence differences exist but retaining enough specificity to ensure amplification of the correct amplicon. Preferably a PCR amplicon is designed to have a restriction enzyme site in one allele but not the other. Primers are generally 18-25 base pairs in length with similar melting temperatures.

PCR Amplification

The composition of PCR reactions has been described elsewhere (Clinical Applications of PCR, Dennis Lo (Editor), Blackwell Publishing, 1998). Briefly, a reaction contains primers, DNA, buffers and a thermostable polymerase enzyme. The reaction is cycled (up to 50 times) through temperature steps of denaturation, hybridization and DNA extension on a thermocycler such as the MJ Research Thermocycler model PTC-96V.

DNA Analysis

PCR products can be analyzed using a variety of methods including size differentiation using mass spectrometry, capillary gel electrophoresis and agarose gel electrophoresis. If the PCR amplicons have been designed to contain differential restriction enzyme sites, the DNA in the PCR reaction is purified using DNA-binding columns or precipitation and re-suspended in water, and then restricted using the appropriate restriction enzyme. The restricted DNA can then be run on an agarose gel where DNA is separated by size using electric current. Various alleles of a gene will have different sizes depending on whether they contain restriction sites.

Example 2

Identification of Diagnostic Marker Genes and Priority Ranking of Genes

For experimental Group 1, differences in gene expression between animals before and after infection with EHV were analyzed using the empirical Bayes approach of Lonnstedt and Speed (Lonnstedt and Speed, 2002, *Statistica Sinica* 12: 3146). Analyzes were performed, comparing each post-infection time point with the pre-infection time point. A general linear model was fitted to each gene, with terms for individual animal effects, and a term for clinical status (before or after infection with EHV). Genes were ranked according to their posterior odds of differential expression between clinical status groups. Only those genes with statistically significant changes (assessed using the t statistic based on the empirical Bayes shrunken standard deviations) were recorded. Strong control of the type 1 Error rate was maintained, using Holm's adjustment to the p Values (Holm, S. 1979, *Scandinavian Journal of Statistics* 6: 65-70). Genes which showed statistically significant differences before and after infection with EHV were tabulated for each day post infection.

In addition, analyzes were performed comparing animals clinically affected (demonstrating clinical signs of EHV infection) and healthy animals; and comparing animals deemed to have "active viral infection" and healthy animals (in general, "active viral infection" animals included a period of approximately 7 days following known infection with EHV).

Table 5 shows genes significantly different following these analyzes ranked according to p value. Again this analysis is based on a two-group comparison with p Values adjusted using Holm's method. The "effect size" (M) in these Tables represents a log value, indicating the fold change of gene expression compared to control. Negative values represent down regulation and positive values indicate up regulation. The t statistic and p value are significance values as described herein. The B statistic is a Bayesian posterior log odds of differential expression.

Table 6 shows genes significantly different following these analyzes ranked according to T value. Sign indicates which genes are up and down regulated (negative or positive "Difference" and t values) and the magnitude of the response is indicated by "Difference". Again this analysis is based on a two-group comparison with p Values adjusted using Holm's method.

Example 3

Demonstration of Diagnostic Potential to Determine Herpes Virus Infection

In addition, at each time post-infection, the diagnostic potential of the entire set of genes was assessed using discriminant analysis (Venables and Ripley, 2002, Modern Applied Statistics in S, Springer) on the principal component scores (Jolliffe, I. T. Principal components analysis, Springer-Verlag, 1986) calculated from gene expression. The entire process was crossvalidated. Cross validation was achieved dropping one animal at a time (rather than one observation). Sensitivity and specificity were calculated for a uniform prior. This may be interpreted as a form of shrinkage regularization, where the estimates are shrunken to lie in a reduced space.

Cross-validated discriminant function scores were used to estimate a receiver operator curve. The receiver operator curve was calculated by moving a critical threshold along the axis of the discriminant function scores. Both raw empirical ROCs were calculated, and smoothed ROCs using Lloyd's method (Lloyd, C. J. 1998, *Journal of the American Statistical Association* 93: 1356-1364). Curves were calculated for the comparison of clinically negative and clinically positive animals. Separate curves were calculated, using gene expression at each day post-infection. The area under the receiver operator curve was calculated by the trapezoidal rule, applied to both the empirical ROC and the smoothed ROC.

The ROC provides a useful summary of the diagnostic potential of an assay. A perfect diagnostic assay has a ROC which is a horizontal line passing through the point with sensitivity and specificity both equal to one. The area under the ROC for such a perfect diagnostic is 1. A useless diagnostic assay has a ROC which is given by a 45 degree line through the origin. The area for such an uninformative diagnostic is 0.5.

Sensitivity, and selectivity and the areas under the ROC are shown in Table 8, for samples taken 2, 4, 13 and 20 days after infection for Group 1 foals. From these results, there is evidence of strong diagnostic potential at 2 and 4 days after infection (coinciding with the period of maximum clinical signs), but very little evidence of diagnostic potential at 13 or at 20 days.

In addition, comparisons were made between the periods 0, 13 and 20 days after infection with 2, 4 and 6 days after infection—corresponding to the symptomatic vs asymptomatic time points for Group 1 foals. The ROC for the comparison is shown in FIG. 1. The sensitivity and specificity for the comparison was ROC were 1 and 0.867 respectively. The area under the empirical and smoothed ROC were 0.982 and 0.952 respectively. These constitute very strong evidence for differential gene expression corresponding to symptomatic EHV infection.

Figure 2:
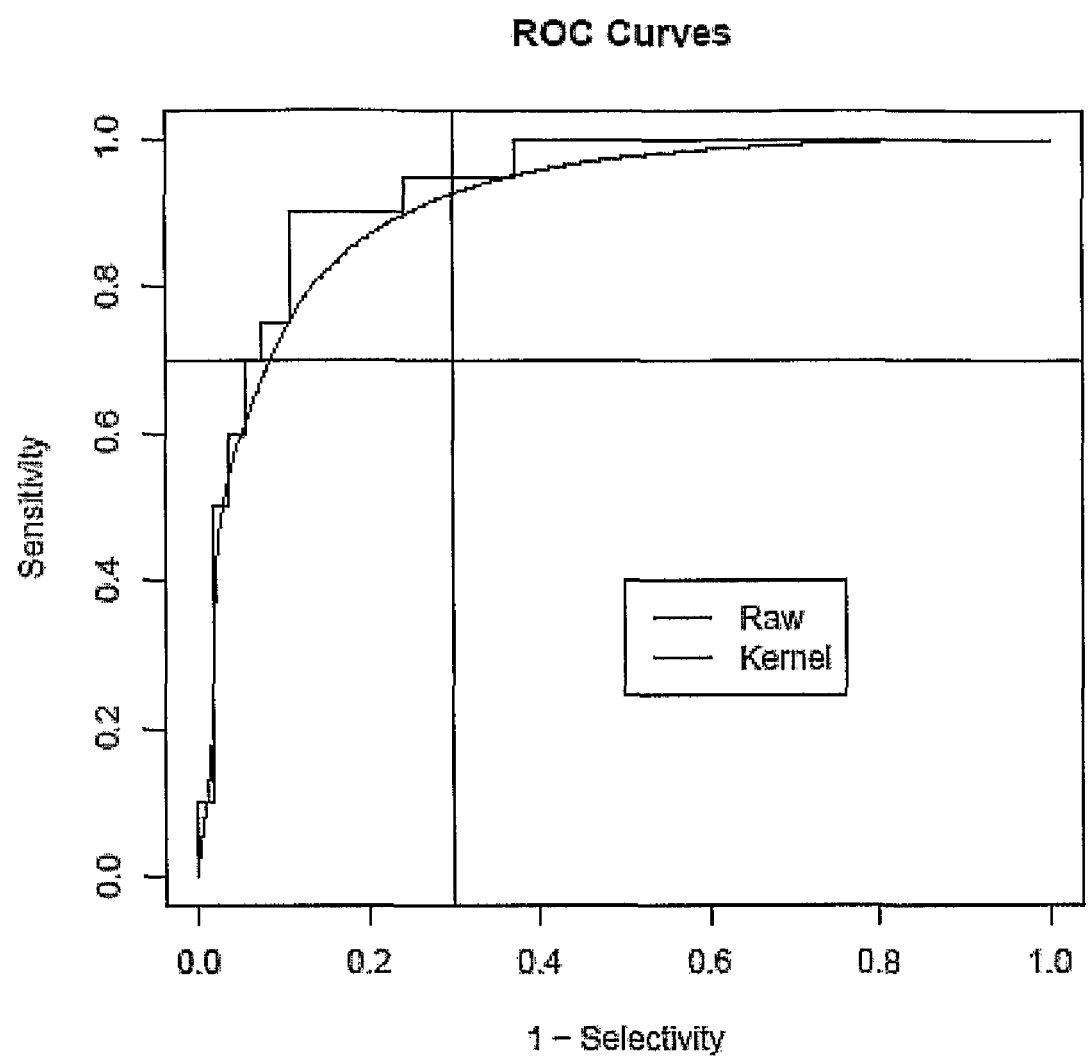
FIG. 2 is a graphical representation of a Receiver Operator Curve when using the selected genes for clinically affected animals. The sensitivity and specificity of a test using the gene expression signature is excellent.

In addition, an ROC curve (FIG. 2) was generated using the selected genes for clinically affected animals. The sensitivity and specificity of a test using the gene expression signature is excellent.

Figure 3:
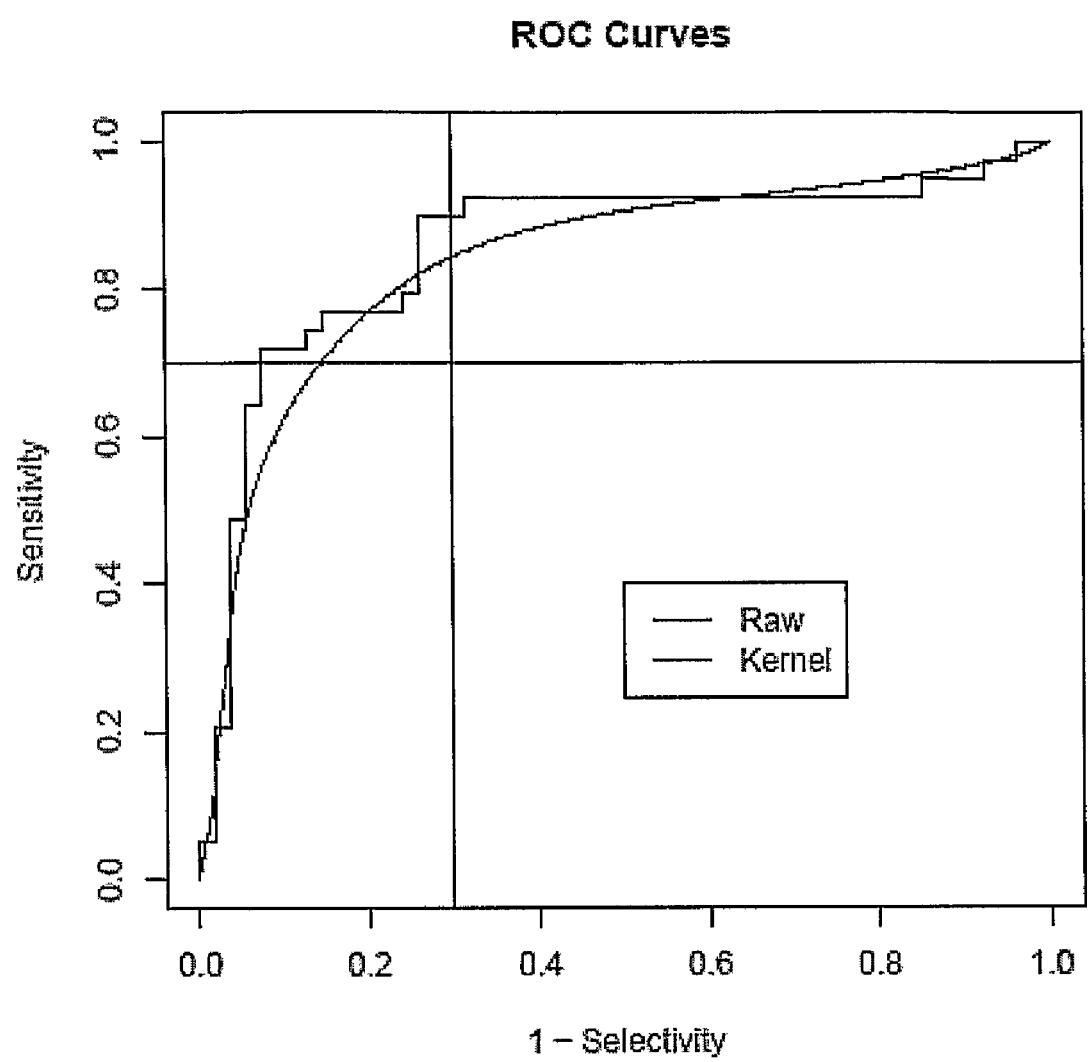
FIG. 3 is a graphical representation of a Receiver Operator Curve when using the selected genes for animals deemed to have active viral infection. The sensitivity and specificity of a test using the gene expression signature is excellent.

In addition, an ROC curve (FIG. 3) was generated using the selected genes for animals deemed to have active viral infection. The sensitivity and specificity of a test using the gene expression signature is excellent.

Figure 4:
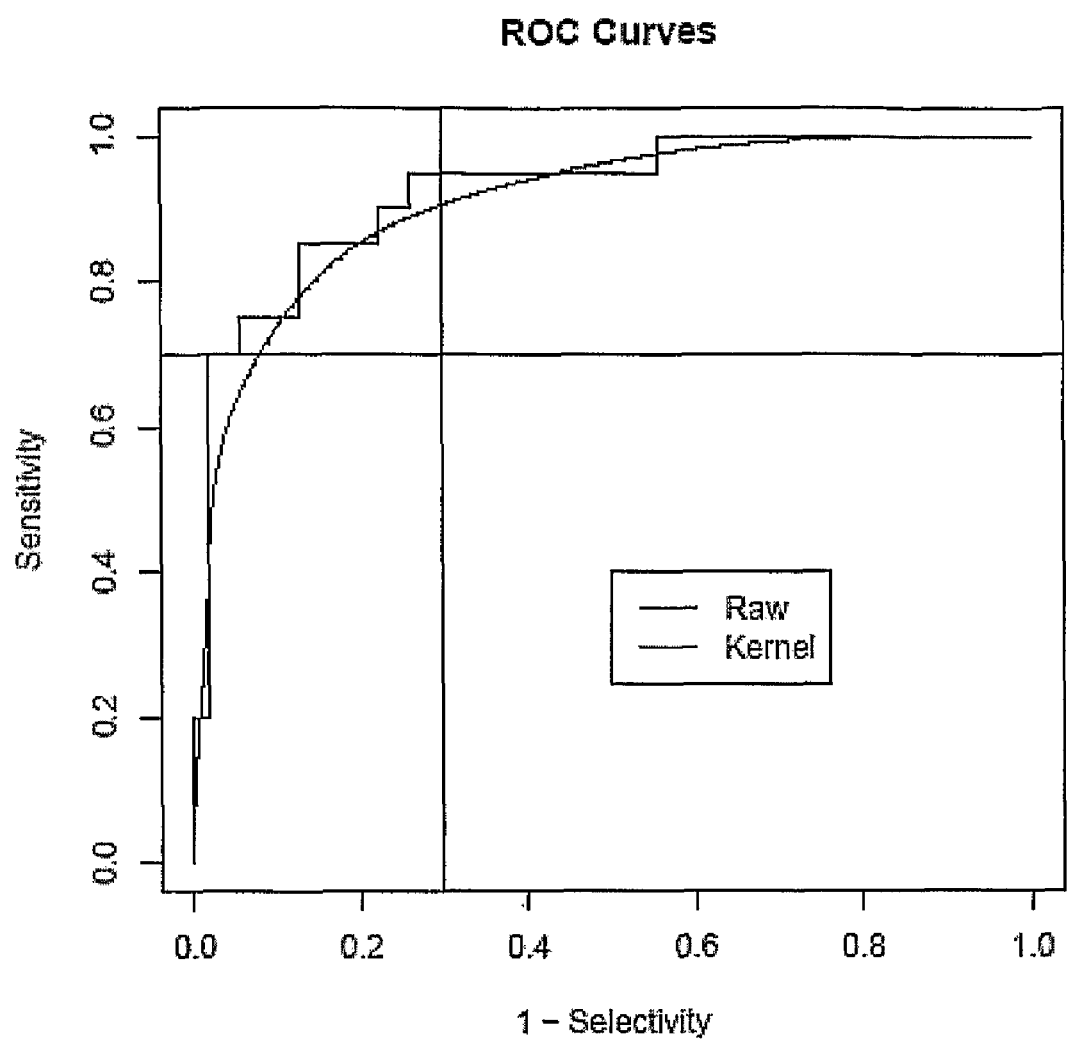
FIG. 4 is a graphical representation of a Receiver Operator Curve when using all of the genes for clinically affected animals. The sensitivity and specificity of a test using the gene expression signature is good.

In addition, an ROC curve (FIG. 4) was generated using all of the genes for clinically affected animals. The sensitivity and specificity of a test using the gene expression signature is good.

Figure 5:
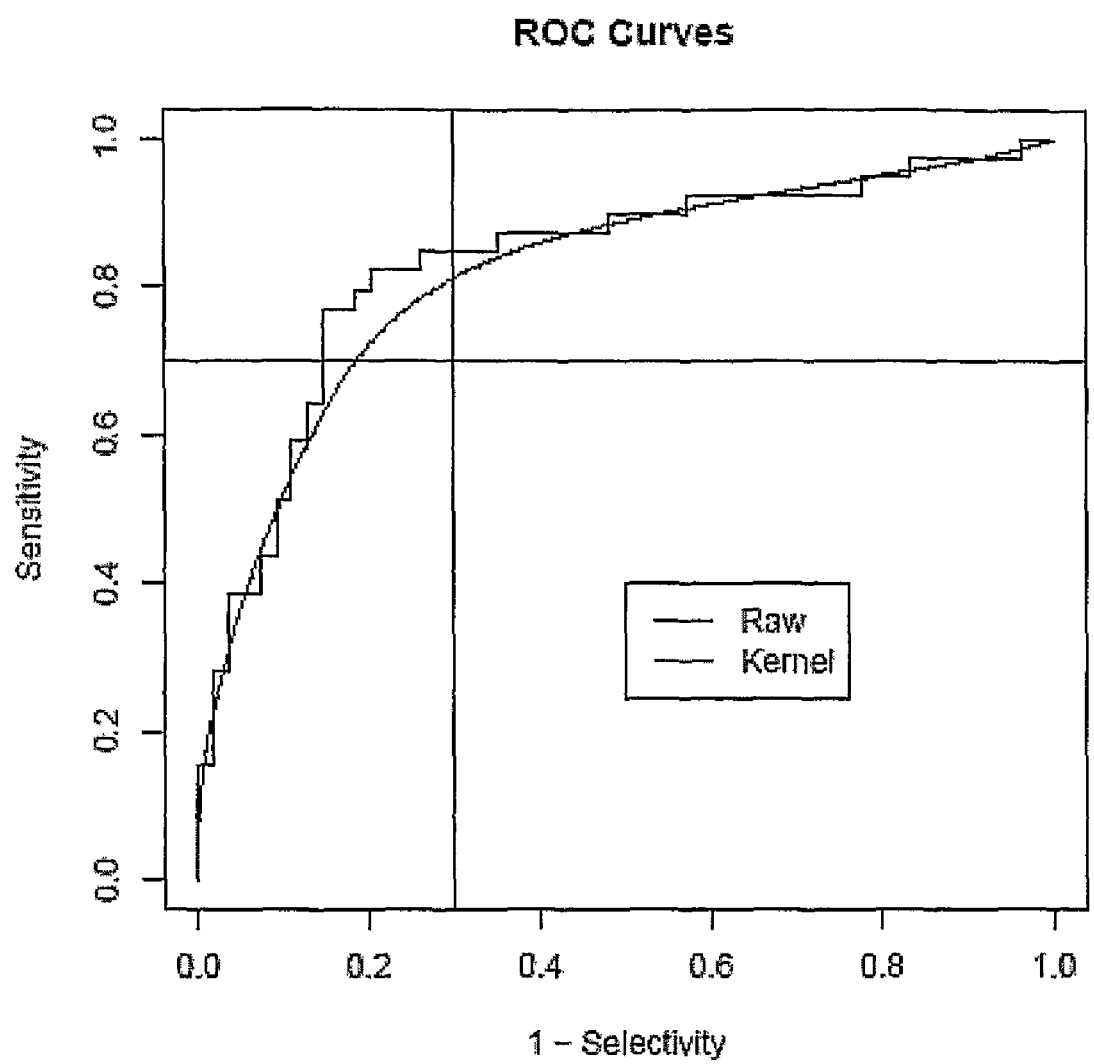
FIG. 5 is a graphical representation of a Receiver Operator Curve when using the selected genes for animals deemed to have active viral infection. The sensitivity and specificity of a test using the gene expression signature is good.

In addition, an ROC curve (FIG. 5) was generated using all of the genes for animals deemed to have active viral infection. The sensitivity and specificity of a test using the gene expression signature is good.

Receiver Operator curves calculated in this way, based on shrinkage estimates over the entire set of genes on the chip are conservative—that is, they tend to underestimate the diagnostic potential. Better diagnostic performance should be obtained in operational diagnostics, based on a selected subset of the genes.

Hematology and biochemistry results, clinical parameters (heart rate (HR), and respiratory rate (RR)) and statistical significance of these parameters for Days 2, 4, 6, 13 and 20 compared to Day 0 for foals in Group 1 are presented in Table 7. All of the measurements except for PCV (packed cell volume) are statistically significant and most likely reflect changes associated with herpes virus infection. However, these changes are non-specific and can be associated with many other conditions. Similar results for parameters from foals in Group 2 are not presented as there were no significant differences despite the fact that these foals were infected albeit subclinically.

Figure 6:
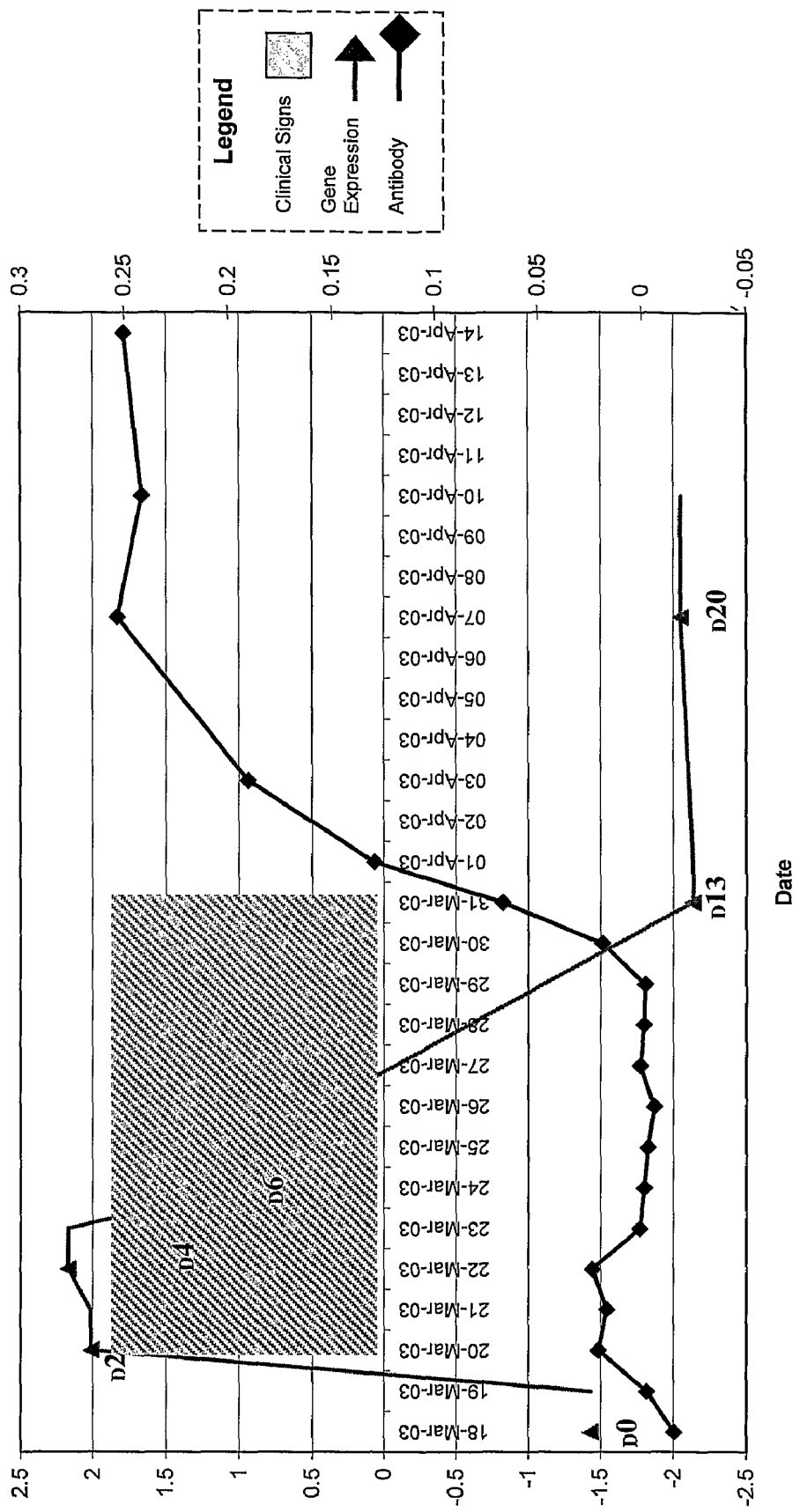
FIG. 6 is a graphical representation showing a plot of Gene Expression Index (Log Intensity Units), Serum EHV Ab Levels (450 nm absorbance), Dates, Days (D=Day) and Clinical Signs for EHV-1 Group 1 foals. Foals were inoculated on 18 Mar. 2003. The changes in gene expression index correspond to the presence of clinical signs and precede the rise in specific serum anti-EHV-1 antibodies by 10-14 days.

FIG. 6 is a plot of Gene Expression Index (Log Intensity Units), Serum EHV Ab Levels (450 nm absorbance), Dates, Days (D=Day), Clinical Signs for foals in Group 1. Group 1 foals were inoculated (experimentally infected) on 18 Mar. 2003. The changes in gene expression index correspond to the presence of clinical signs and precede the rise in specific serum anti-EHV-1 antibodies by 10-14 days. This ability to diagnose herpes virus infection 10-14 days earlier than antibody-based tests, and during the period of demonstrable clinical signs, has practical significance in treatment and management. For example, it is during this period that current drugs are most efficacious, and for many herpes virus infections when animals are most infectious.

Figure 7:
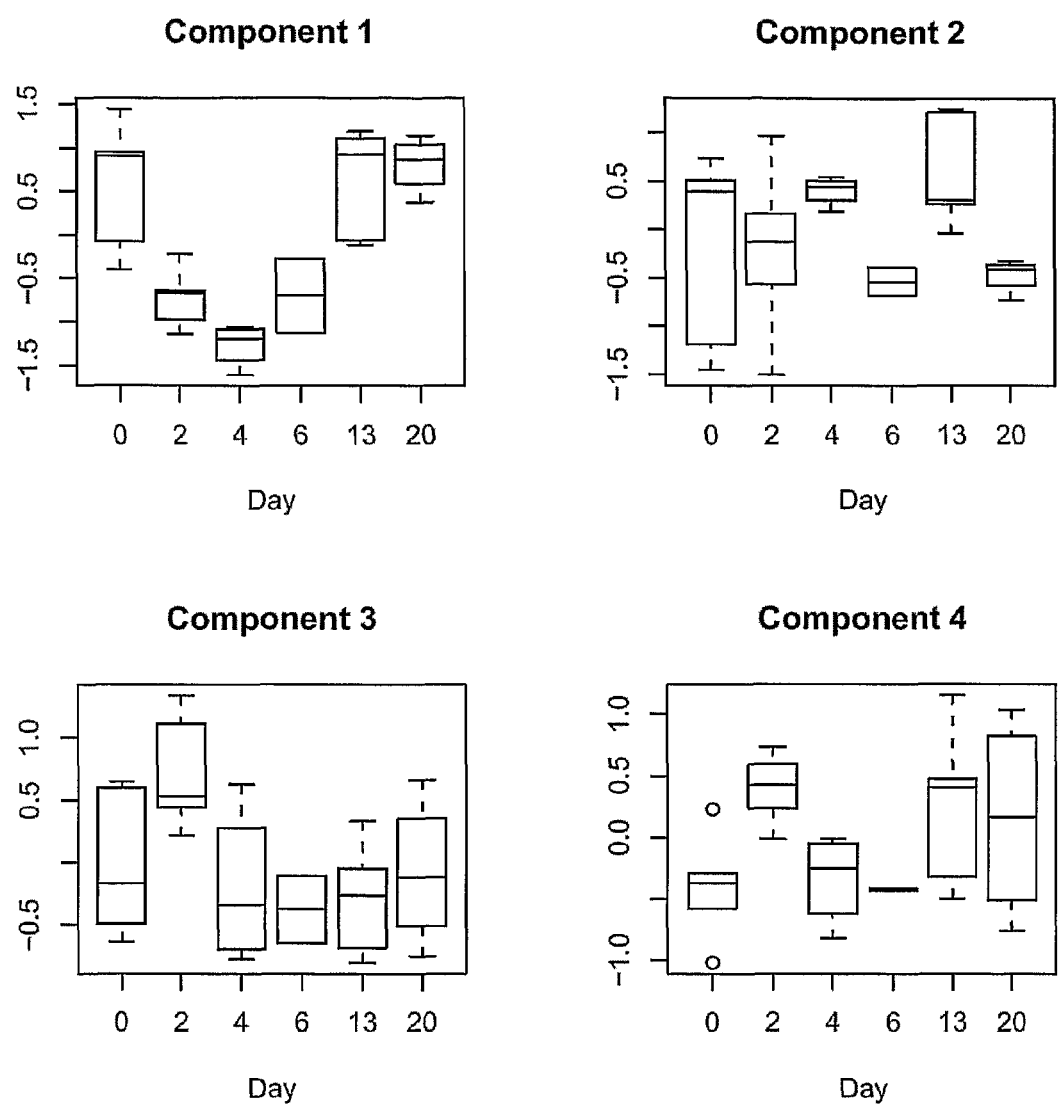
FIG. 7 is a graphical representation of a principal components analysis for Group 1 foals. Components are plotted by days after inoculation.

FIG. 7 contains plots of the first four principal components using gene expression for all genes for Group 1 foals. Components are plotted by days after inoculation. It is clear from these plots that the major changes in gene expression are occurring during the 10-day period following inoculation with herpes virus. This period also corresponds to the presence of clinical signs (see FIG. 2).

Because Group 2 foals were subject to uncontrolled natural infection at varying time points, the gene expression classifier trained on the data for Group 1 foals was used on each sample to predict the EHV infection status for Group 2 foals. This prediction involves a predicted (maximum posterior probability) and a predicted discriminant function score (which is a linear combination of each gene from the sample). Both the predicted class (positive or negative for EHV infection) and the discriminant score are shown in Table 9.

Using the serum EHV-1 Ab results, it was determined that four (4) of the foals (360, 364, 368 and 369: see Table 9) were all probably naturally infected on Day −4 (i.e. four days prior to the beginning of the experiment (Day 0)). Of these, foals 364 and 368 showed clinical signs on Days 0 & 2 and Day 2 respectively. It is noteworthy that when we used the gene classifier, each of these foals was determined to be infected with EHV-1 in some or all of the days between Days 0 and 4. This indicates that the EHV-1 gene signature could be diagnostic of EHV-1 whether or not the animal is exhibiting clinical signs. Using the serum EHV-1 Ab results, it was determined that foal 362 was naturally infected on Day −1—meaning that a signature ought to be able to be detected anywhere between Day −1 and Day 6. Using the gene classifier, positive (meaning 'infected') results were observed in this foal in Days 0, 2 and 6. No clinical signs were apparent in this animal. Foal 375 was infected around Day 6 on the basis of the serum EHV-1 Ab results. Positive classifiers were observed on Days 2, 4 and 6, but again, no clinical signs were apparent. In Foal 366, using the serum EHV-1 Ab results, it was determined that this animal was unlikely to be naturally infected until Day 14—meaning that seroconversion occurred around Day 27 or 28. Note that the animals in Trial 2 were all challenged at Day 21. Accordingly, this foal was sero-negative for EHV-1 at Day 21. Foal 366 did not develop any clinical signs except mildly on Day 23. These results would appear to indicate that the serum Ab levels (humoral immunity) were almost sufficient by the time of experimental challenge (Day 21) to protect the animal from overt signs of clinical disease. Accordingly, we did not see any positive results when the gene expression classifier was applied during the period following experimental inoculation.

Thus, Group 2 foals have shown that a preliminary classifier developed from Group 1 foals can identify early natural infection with EHV-1 in the presence or absence of clinical signs (or any significant changes in hematology and biochemistry).

Example 4

Predictive Gene Sets

Although about 63 genes have been identified as having diagnostic potential, a much fewer number are generally required for acceptable diagnostic performance.

Table 10 shows the cross-validated classification success, sensitivity and specificity obtained from a linear discriminant analysis, based on two genes selected from the set of potential diagnostic genes. The pairs presented are those producing the highest prediction success, many other pairs of genes produce acceptable classification success. The identification of alternate pairs of genes would be readily apparent to those skilled in the art. Techniques for identifying pairs include (but are not limited to) forward variable selection (Venables W. N. and Ripley B. D. Modern Applied Statistics in S 4th Edition 2002. Springer), best subsets selection, backwards elimination (Venables W. N. and Ripley B. D., 2002, supra), stepwise selection (Venables W. N. and Ripley B. D., 2002, supra) and stochastic variable elimination (Figueirodo M. A. Adaptive Sparseness for Supervised Learning).

Table 11 shows the cross-validated classification success obtained from a linear discriminant analysis based on three genes selected from the diagnostic set. Only twenty sets of three genes are presented. It will be readily apparent to those of skill in the art that other suitable diagnostic selections based on three HVI marker genes can be made.

Table 12 shows the cross-validated classification success obtained from a linear discriminant analysis based on four genes selected from the diagnostic set. Only twenty sets of four genes are presented. It will be readily apparent to practitioners in the art that other suitable diagnostic selections based on four HVI marker genes can be made.

Table 13 shows the cross-validated classification success obtained from a linear discriminant analysis based on five genes selected from the diagnostic set. Only twenty sets of five genes are presented. It will be readily apparent to practitioners in the art that other suitable diagnostic selections based on five HVI marker genes can be made.

Table 14 shows the cross-validated classification success obtained from a linear discriminant analysis based on six genes selected from the diagnostic set. Only twenty sets of six genes are presented. It will be readily apparent to practitioners in the art that other suitable diagnostic selections based on six HVI marker genes can be made.

Table 15 shows the cross-validated classification success obtained from a linear discriminant analysis based on seven genes selected from the diagnostic set. Only twenty sets of seven genes are presented. It will be readily apparent to practitioners in the art that other suitable diagnostic selections based on seven HVI marker genes can be made.

Table 16 shows the cross-validated classification success obtained from a linear discriminant analysis based on eight genes selected from the diagnostic set. Only twenty sets of eight genes are presented. It will be readily apparent to practitioners in the art that other suitable diagnostic selections based on eight HVI marker genes can be made.

Table 17 shows the cross-validated classification success obtained from a linear discriminant analysis based on nine genes selected from the diagnostic set. Only twenty sets of nine genes are presented. It will be readily apparent to practitioners in the art that other suitable diagnostic selections based on nine HVI marker genes can be made.

Table 18 shows the cross-validated classification success obtained from a linear discriminant analysis based on ten genes selected from the diagnostic set. Only twenty sets of ten genes are presented. It will be readily apparent to practitioners in the art that other suitable diagnostic selections based on ten HVI marker genes can be made.

Table 19 shows the cross-validated classification success obtained from a linear discriminant analysis based on 20 genes selected from the diagnostic set. Only 20 sets of twenty genes are presented. It will be readily apparent to practitioners in the art that other suitable diagnostic selections based on twenty HVI marker genes can be made.

Table 20 shows the cross-validated classification success obtained from a linear discriminant analysis based on 30 genes selected from the diagnostic set. Only 20 sets of twenty genes are presented. It will be readily apparent to practitioners in the art that other suitable diagnostic selections based on twenty HVI marker genes can be made.

Further genes introduced noise (and subsequently lowered crossvalidated sensitivity and specificity) through over-fitting.

Example 5

Demonstration of Specificity

The specificity of the Herpes virus signature was examined by training a classifier on the trial data only and running the classifier over a large gene expression dataset of over 850 GeneChips™. Gene expression results in the database were obtained from samples from horses with various diseases and conditions including; clinical, induced acute and chronic EPM, herpes virus infection, degenerative osteoarthritis, stress, *Rhodococcus* infection, endotoxaemia, laminitis, gastric ulcer syndrome, animals in athletic training and clinically normal animals.

Two classifiers were generated. Both were based on the comparison of active viral infection versus clinically normal horses. The first used all the genes on the GeneChip™. The second used only those genes listed in Table 1. The latter signature was able to identify all known EHV-infected animals. It also identified 25 other horses of unknown EHV status, including animals under stress as part of another clinical trial, and five foals with known lung lesions associated with *Rhodococcus equi* infection.

Using this method and a gene signature of 63 genes, a specificity of 95% and sensitivity of 100% for herpes virus infection was obtained from a population sample size of over 850.

Example 7

Gene Ontology

Gene sequences were compared against the GenBank database using the BLAST algorithm (Altschul, S. F., Gish, W., Miller, W., Myers, E. W. & Lipman, D. J. (1990) "Basic local alignment search tool." J. Mol. Biol. 215:403-410), and gene homology and gene ontology searches were performed in order to group genes based on function, metabolic processes or cellular component. Table 21 lists and groups the genes based on these criteria. In some instances there is no information available (NA). See also Table 1, which contains sequence information for each gene.

The disclosure of every patent, patent application, and publication cited herein is hereby incorporated herein by reference in its entirety.

The citation of any reference herein should not be construed as an admission that such reference is available as "Prior Art" to the instant application.

Throughout the specification the aim has been to describe the preferred embodiments of the invention without limiting the invention to any one embodiment or specific collection of features. Those of skill in the art will therefore appreciate that, in light of the instant disclosure, various modifications and changes can be made in the particular embodiments exemplified without departing from the scope of the present invention. All such modifications and changes are intended to be included within the scope of the appended claims.

TABLE 1

| Gene | GenBank Homology | DNA SEQUENCE/DEDUCED AMINO ACID SEQUENCE | SEQUENCE IDENTIFIER: |
|---|---|---|---|
| B1961481.V1.3_AT | No Homology | 1 ACTGACAGTTGAAACGATCAATGGAATGATCAGCACAAACAGAAAATATTACTGTTACTG<br>61 TAATATTATGTGATATCCTCTATATCTAAGATATATATTATATATATGATGTAAGATAAG<br>121 ATATATATTAAATATATAATGTAATATATATTTATATAACATGTACTCTCTCTATATATAC<br>181 ATATGTATCACGTAATGTATATATATAATGTAATATAATATTGCTGTTACTGGAAAGATG<br>241 ACCGCAAGAAGTTGATTTTTTATCTACCAGAAGTTTTCTTCGCTGTGTTTAAGTCGGCG<br>301 ATCTGCTTTGATCGTTTTGTTCGCTTCTGCTGTTTGAGAAGAACGATTGAAAGGAGCCA | SEQ ID NO: 1 |
| WBC026C03_V1.3_AT | Homo sapiens interferon, gamma-inducible protein 16, mRNA. | 1 GCAGAATAGGAGCAAGCCAGCACTAGTCAGCTAACTAAGTGACTCAACCAAGGCCTTTTT<br>61 TCCTTGTTATCTTTGCAGATACTTCATTTTCTTAGCGTTTCTGGAGATTACAACATCCTG<br>121 CGGTTCCGTTTCTGGGAACTTTACTGATTTATCTCCCCCCTCACACAAATAAGCATTGAT<br>181 TCCTGCATTTCTGAAGATCTCAAGTACTGGTACTGTTGAAAAAATTTCCAGTGAGGCT<br>241 CACTTATGTCTGTAAAGATGGGAAAAAAATCAAGAACATTGTTCTACTAAAAGGATTAG<br>301 AGGTCATCAATGATTATCATTTTAGAATGGTTAAGTCCTTACTGAGCAACGATTTAAAAC<br>361 TTAATTTAAAAATGAGAGAAGAGTATGACAAAATTCAGATTGCTGACTTGATGGAAGAAA<br>421 AGTTCCGAGGTGATGCTGGTTTGGGCAAACTAATAAAAATTTTCGAAGATATACCAACGC<br>481 TTGAAGACCTGGCTGAAACTCTTAAAAAGAAAAGTTGTAAAAGGACCAGCCAGCCCTAT<br>541 CAAGAAAGAGGAAGAAGGAAGTGGATGCTACTTCACCTGCACCCTCCACAAGCAGCACTG<br>601 TCAAAACTGAAGGAGCAGAGGCAACTCCTGGAGCTCAGAAAAGAAAAAAATCAACCAAAG<br>661 AAAAGGCTGGACCCAAAGGGAGTAAGGTGTCCGAGGAACAGACTCAGCCTCCCTCTCCTG<br>721 CAGGAGCCGGCATGTCCACAGCCATGGGCCGTTCCCCATCTCCCAAGACCTCATTGTCAG<br>781 CTCCACCCAACACTTCTTCAACTGAGAACCCGAAAACAGTGGCCAAATGTCAGGTAACTC<br>841 CCAGAAGAAATGTTCTCCAAAAACGCCCAGTGATAGTGAAGGTACTGAGTACAACAAAGC<br>901 CATTTGAATATGAGACCCCAGAAATGGAGAAAAAAATAATGTTTCATGCTACAGTGGCTA<br>961 CACAGACACAGTTCTTCCATGTGAAGGTTTTAAACACCAGCTTGAAGGAGAAATTCAATG<br>1021 GAAAGAAATCATCATCATATCAGATTATTTGGAATATGATAGTCTCCTAGAGGTCAATG<br>1081 AAGAATCTACTGTATCTGAAGCTGGTCCTAACCAAACGTTTGAGGTTCCAAATAAAATCA<br>1141 TCAACAGAGCAAAGGAAACTCTGAAGATTGATATTCTTCACAAACAAGCTTCAGGAAATA<br>1201 TTTGTATATGGGGTATTTATGCTACATAAGAAAACAGTAAATCAGAAGACCACAATCTACG<br>1261 AAATTCAGGATGATAGAGGAAAATGGATGTAGTGGGGACAGGACAATGTCACAATATCC<br>1321 CCTGTGAAGAAGGAGATAAGCTCCAACTTTTCTGCTTTCGACTTAGAAAAAAGAACCAGA<br>1381 TGTCAAAACTGATTTTCAGAAATGCATAGTTTTATCCAGATAAAGAAAAAAACAAACCCGA<br>1441 GAAACAATGACCCCAAGACATGAAGCTACCCCAGGAACAGAGTCAGCTTCCAAATCCTT<br>1501 CAGAGGCCAGCACAACCTTCCCTGAGAGCCATCTTCGGACTCCTCAGATGCCACCAACAA<br>1561 CTCCATCCAGCAGTTTCTTCACCAAGAAAGTGAAGACACAATCTCCAAATGAATGACT<br>1621 TCATGAGGATGCAGATACTGAAGGAAGGGAGTCATTTTCCAGGACCGTTCATGACCAGCA<br>1681 TAGGCCCAGCTGAGAGCCATCCCCACACTCCTCAGGTGCCACCACCAACCCCATCCAGCA<br>1741 GTTCCTTAATCAAGAAGAAACCAAGATTGAAGGCTGTACCTAAAGAAGCTTCCAAAGAAG<br>1801 AGGGTCTACAGACGGACCCCAAAGAAGTGATGGTACTGAAGGCAACAGAACCATTTGCAT<br>1861 ATGAGCCCAAAGAGCAGAAGAAAATGTTCCATGCCACAGTGGCTACTGAGAGCCAGTTCT<br>1921 TCCGAGTGAAGGTTTTTGATGTCAGTCTGAAGCAGAAGTTCATCCCAAAGAAAATCATTG<br>1981 CCATATCAGATTATATTGGCCGCAATGGGTTCCTGGAGGTGTACAGTGCCTCATCTGTGT<br>2041 CTGATGTTAATGCTGACCGAAAGATGGAGGTCTCAAAAGACTGATTGCAAATGCAAATG<br>2101 CAACTCCTAAAATCAATCATCTGTGCTCACAAGCTCCAGGAACATTTGTGAATGGGGTGT<br>2161 ATGAGGTGCATAAGAAAATAGTGTGAATGATTTCATATATTATGAAATACAAGATGATA<br>2221 CAGGGAAGATGAAGTCATGGTGTATGGACGACTGACCAAAATCAACTGCGAGGAAAGAG<br>2281 ATAAACTTCAACTCATCTGCTTTGAATTGGCACCGAAAGTGGGAATACCGGGGAGTTGA<br>2341 GATCTGTAATTCACAGTTTCATCAAGGTCATCAAGGCCAGGTAAAGCAAGAAAGACATAC<br>2401 TCAATCCTGATTCAAGTATGGAAACTTCACCAGACTTTTTCTTCTAAAATCTGGATGTCA<br>2461 TTGACGATAATGTTTATGGAGATAAGGCTCAAGTGCCTAAAAAAATGTACATATACCTGG<br>2521 TTGAAATACAACACTATACATACACACCACCATATATACTAGCTGTTAATCCTATGGAAT<br>2581 GGGGTATTGGGAGTGCTTTTTAATTTTTCATAGTTTTTTTTAATAAAATGGCATATTT<br>2641 TGCATCTACAACTTCTATAATTTGAAAAAATAAATAAACATTATCTTTTTGTGAAAAAA<br>2701 AAAAAAAAA | SEQ ID NO: 2 |
| | | 1  M  G  K  K  Y  K  N  I  V  L  L  K  G  L  E  V  I  N  D  Y<br>1 ATGGGAAAAAAATACAAGAACATTGTTCTACTAAAAGGATTAGAGGTCATCAATGATTAT<br>21  H  F  R  M  V  K  S  L  L  S  N  D  L  K  L  N  L  K  M  R<br>61 CATTTTAGAATGGTTAAGTCCTTACTGAGCAACGATTTAAAACTTAATTTAAAAATGAGA<br>41  E  E  Y  D  K  I  Q  I  A  D  L  M  E  E  K  F  R  G  D  A<br>121 GAAGAGTATGACAAAATTCAGATTGCTGACTTGATGGAAGAAAAGTTCCGAGGTGATGCT<br>61  G  L  G  K  L  I  K  I  F  E  D  I  P  T  L  E  D  L  A  E<br>181 GGTTTGGGCAAACTAATAAAAATTTTCGAAGATATACCAACGCTTGAAGACCTGGCTGAA<br>81  T  L  K  K  E  K  L  K  V  K  G  P  A  L  S  R  K  R  K  K<br>241 ACTCTTAAAAAGAAAGTTAAAAGTAAAAGGACCAGCCCTATCAAGAAAGAGGAAGAAG<br>101  E  V  D  A  T  S  P  A  P  S  T  S  S  T  V  K  T  E  G  A<br>301 GAAGTGGATGCTACTTCACCTGCACCCTCCACAAGCAGCACTGTCAAAACTGAAGGAGCA<br>121  E  A  T  P  G  A  Q  K  R  K  K  S  T  K  E  K  A  G  P  K<br>361 GAGGCAACTCCTGGAGCTCAGAAAAGAAAAAAATCAACCAAAGAAAAGGCTGGACCCAAA<br>141  G  S  K  V  S  E  E  Q  T  Q  P  P  S  P  A  G  A  G  M  S<br>421 GGGAGTAAGGTGTCCGAGGAACAGACTCAGCCTCCCTCTCCTGCAGGAGCCGGCATGTCC<br>161  T  A  M  G  R  S  P  S  P  K  T  S  L  S  A  P  P  N  T  S<br>481 ACAGCCATGGGCCGTTCCCCATCTCCCAAGACCTCATTGTCAGCTCCACCCAACACTTCT<br>181  S  T  E  N  P  K  T  V  A  K  C  Q  V  T  P  R  R  N  V  L<br>541 TCAACTGAGAACCCGAAAACAGTGGCCAAATGTCAGGTAACTCCCAGAAGAAATGTTCTC | SEQ ID NO: 3 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 201 Q K R P V I V K V L S T T K P F E Y E T<br>601 CAAAAACGCCCAGTGATAGTGAAGCTACTGAGTACAACAAAGCCATTTGAATATGAGACC<br>221 P E M E K K I M F H A T V A T Q T Q F F<br>661 CCAGAAATGGAGAAAAAATAATGTTTCATGCTACAGTGGCTACACAGACACAGTTCTTC<br>241 H V K V L N T S L K E K F N G K K I I I<br>721 CATGTGAAGGTTTTAAACACCAGCTTGAAGGAGAAATTCAATGGAAAGAAAATCATCATC<br>261 I S D Y L E Y D S L L E V N E E S T V S<br>781 ATATCAGATTATTTGGAATATGATAGTCTCCTAGAGGTCAATGAAGAATCTACTGTATCT<br>281 E A G P N Q T F E V P N K I I N R A K E<br>841 GAAGCTGGTCCTAACCAAACGTTTGAGGTTCCAAATAAAATCATCAACAGAGCAAAGGAA<br>301 T L K I D I L H K Q A S G N I V Y G V F<br>901 ACTCTGAAGATTGATATTCTTCACAAACAAGCTTCAGGAAATATTGTATATGGGGTATTT<br>321 M L H K K T V N Q K T T I Y E I Q D D R<br>961 ATGCTACATAAGAAAACAGTAAATCAGAAGACCACAATCTACGAAATTCAGGATGATAGA<br>341 G K M D V V G T G Q C H N I P C E E G D<br>1021 GGAAAAATGGATGTAGTGGGGACAGGACAATGTCACAATATCCCTGTGAAGAAGGAGAT<br>361 K L Q L F C F R L R K K N Q M S K L I S<br>1081 AAGCTCCAACTTTTCTGCTTTCGACTTAGAAAAAAGAACCAGATGTCAAAACTGATTTCA<br>381 E M H S F I Q I K K K T N P R N N D P K<br>1141 GAAATGCATAGTTTTATCCAGATAAAGAAAAAAACAAACCCGAGAAACAATGACCCCAAG<br>401 S M K L P Q E Q S Q L P N P S E A S T T<br>1201 AGCATGAAGCTACCCCAGGAACAGAGTCAGCTTCCAAATCCTTCAGAGGCCAGCACAACC<br>421 F P E S H L R T P Q M P P T T P S S S F<br>1261 TTCCCTGAGAGCCATCTTCGGACTCCTCAGATGCCACCAACAACTCCATCCAGCAGTTTC<br>441 F T K K S E D T I S K M N D F H R M Q I<br>1321 TTCACCAAGAAAAGTGAAGACACAATCTCCAAAATGAATGACTTCATGAGGATGCAGATA<br>461 L K E G S H F P G P F M T S I G P A E S<br>1381 CTGAAGGAAGGGAGTCATTTTCCAGGACCGTTCATGACCAGCATAGGCCCAGCTGAGAGC<br>481 H P H T P Q V P P P T P S S S L I K K<br>1441 CATCCCCACACTCCTCAGGTGCCACCACCAACCCCATCCAGCAGTTCCTTAATCAAGAAG<br>501 K P R L K A V P K E A S K E E G L Q T D<br>1501 AAACCAAGATTGAAGGCTGTACCTAAAGAAGCTTCCAAAGAAGAGGGTCTACAGACGGAC<br>521 P K E V M V L K A T E P F A Y E P K E Q<br>1561 CCCAAAGAAGTGATGGTACTGAAGGCAACAGAACCATTTGCATATGAGCCCAAAGAGCAG<br>541 K K M F H A T V A T E S Q F F R V K V F<br>1621 AAGAAAATGTTCCATGCCACAGTGGCTACTGAGAGCCAGTTCTTCCGAGTGAAGGTTTTT<br>561 D V S L K Q K F I P K K I I A I S D Y I<br>1681 GATGTCAGTCTGAAGCAGAAGTTCATCCCAAAGAAAATCATTGCCATATCAGATTATATT<br>581 G R N G F L E V Y S A S S V S D V N A D<br>1741 GGCCGCAATGGGTTCCTGGAGGTGTACAGTGCCTCATCTGTGTCTGATGTTAATGCTGAC<br>601 R K M E V S K R L I A N A N A T P K I N<br>1801 CGAAAGATGGAGGTCTCAAAAAGACTGATTGCAAATGCAAATGCAACTCCTAAAATCAAT<br>621 H L C S Q A P G T F V N G V Y E V H K K<br>1861 CATCTGTGCTCACAAGCTCCAGGAACATTTGTGAATGGGGTGTATGAGGTGCATAAGAAA<br>641 I V W N D F I Y Y E I Q D D T G K M E V<br>1921 ATAGTGTGGAATGATTTCATATATTATGAAATACAAGATGATACAGGGAAGATGGAAGTC<br>661 M V Y G R L T K I N C E E R D K L Q L I<br>1981 ATGGTGTATGGACGACTGACCAAAATCAACTGCGAGGAAAGAGATAAACTTCAACTCATC<br>681 C F E L A P K S G N T G E L K S V I H S<br>2041 TGCTTTGAATTGGCACCGAAAAGTGGGAATACCGGGGAGTTGAGATCTGTAATTCACAGT<br>701 F I K V I K A R -<br>2101 TTCATCAAGGTCATCAAGGCCAGGTAA | |
| WBC005G04_V1.3_AT | H. sapiens myeloid cell nuclear differentiation antigen mRNA, complete cds. | 1 ATTGAGAGTGGCTCTAACAAGTGCCATTTTTCCTTGTTAGCTTTCATTTCTCAGCCCTTT<br>61 ACAAGATTAAAATAGTCTGCAGTTTAATCTCTCCAAAGCTTTACGGACAGTGATTCTGTC<br>121 CTAAACAAGACAGTGACTCCAGGATTTCTGAAGACTATTGTGGAAGAAGCATCCATTAAG<br>181 GCCAAGCTATAACATCAGAAATGGTGAATGAATACAAGAAAATTCTTTTGCTGAAAGGAT<br>241 TTGAGCTCATGGATGATTATCATTTTACATCAATTAAGTCCTTACTGGCTAGATTTAG<br>301 GACTAACTACAAAAATGCAAGAGGAATACAACAGAATTAAGATTACAGATTTGATGGAAA<br>361 AAAAGTTCCAAGGCGTTGCCTGTCTAGACAAACTAATAGAACTTGCCAAAGATATGCCAT<br>421 CACTTAAAAACCTTGTTAACAATCTTCGAAAAGAGAAGTCAAAAGTTTGCTAAGAAAATTA<br>481 AAACACAAGAAAAAGCTCCAGTGAAAAAATAAACCAGGAAGAAGTGGGTCTTGCGGCAC<br>541 CTGCACCCACCGCAAGAAACAAACTGACATCGGAAGCAAGAGGGAGGATTCCTGTAGCTC<br>601 AGAAAAGAAAAACTCCAAACAAAGAAAAGACTGAAGCCAAAAGGAATAAGGTGTCCCAAG<br>661 AGCAGAGTAAGCCCCCAGGTCCCTCAGAGCCAGCACATCTGCAGCTGTGGATCATCCCC<br>721 CACTACCCCAGACCTCATCATCAACTCCATCCAACACTTCGTTTACTCCGAATCAGGAAA<br>781 CCCAGGCCCAACGGCAGGTGGATCAAGAAGAAATGTTCCCAAAACGACCCAGTGACAG<br>841 TGGTGGTACTGAAAGCAACAGCGCCATTTAAATACGAGTCCCCAGAAATGGGAAAAGCA<br>901 CAATGTTTCATGCTACAGTGGCTAAGAACTCAATATTTCATGTGAAAGTCTTCGACA<br>961 TCAACTTGAAAGAGAAATTTGTAAGGAAGAAGGTCATTACTATATCAGATTACTTTGAAT<br>1021 GTAAAGGAATCCTGGAGGTAAATGAAGCATCATCTGTATCTGAAGCTGGTATTGATCCAA<br>1081 AGATTGAGGTCCCTACCAGAATTATCAAAAGAGCAAATCAAACTCCCAAGATTGATAATC<br>1141 TTCACAAACAAGCATCGGGAACATTTGTTTATGGGTTGTTTGTGTTACATCAGAAAAAG<br>1201 TGAATAACAAGAACACGATCTATGAAATAGAGGATAAAACAGGAAAGATGGATGTAGTGG | SEQ ID NO: 4 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 1261 GGAATGGAAAATGGCACAATATCAAGTGTGAGGAAGGAGATAAACTTCGACTCTTCTGCT<br>1321 TTCAATTGAGAACACTTGACAAGAGGCTGAAACTGACATGTGGAAATCACAGTTTCATTC<br>1381 AGGTCATCAAGGCTAAGAAAAACAAGGAAGGACCAATGAATGTTAATTGAAATATGAAAG<br>1441 CTGAAATGCAACAAACAACTTCCGCTTAAAACAATTAAGTTGTTAATAACTGTGATTTTG<br>1501 TAAATTTCAGTAATTCATTTAAATGATGTTTCAGTAGATATATTCTAGCATATTAAGAGC<br>1561 TTTTTATAACTGAGTTATAGATTAGTTTGCTTTCTGGAATAAAATTTTCTTCTTATACTCT<br>1621 TCCTTTTTTTTAGATATTACATTTTGCTTTTATGACATTCACGAGGCAAAAACCG<br><br>   1  M  V  N  E  Y  K  K  I  L  L  L  K  G  F  E  L  M  D  D  Y<br>   1 ATGGTGAATGAATACAAGAAAATTCTTTTGCTGAAAGGATTTGAGCTCATGGATGATTAT<br> 21  H  F  T  S  I  K  S  L  L  A  Y  D  L  G  L  T  T  K  M  Q<br> 61 CATTTTACATCAATTAAGTCCTTACTGGCCTATGATTTAGGACTAACTACAAAAATGCAA<br> 41  E  E  Y  N  R  I  K  I  T  D  L  M  E  K  K  F  Q  G  V  A<br>121 GAGGAATACAACAGAATTAAGATTACAGATTTGATGGAAAAAAGTTCCAAGGCGTTGCG<br> 61  C  L  D  K  L  I  E  L  A  K  D  M  P  S  L  K  N  L  V  N<br>181 TGTCTAGACAAACTAATAGAACTTGCCAAAGATATGCCATCACTTAAAAACCTTGTTAAC<br> 81  N  L  R  E  K  S  K  V  A  K  K  I  K  T  Q  E  K  A  P<br>241 AATCTTCGAAAAGAGAAGTCAAAAGTTGCTAAGAAAATTAAAACACAAGAAAAAGCTCCA<br>101  V  K  K  I  N  Q  E  E  V  G  L  A  A  P  A  P  T  A  R  N<br>301 GTGAAAAAAATAAACGAGGAAGAAGTGGGTCTTGGGCACCTGCACCCACCGCAAGAAAC<br>121  K  L  T  S  E  A  R  G  R  I  P  V  A  Q  K  R  K  T  P  N<br>361 AAACTGACATCGGAAGCAAGAGGGAGGATTCCTGTAGCTCAGAAAAGAAAAACTCCAAAC<br>141  K  E  K  T  E  A  K  R  N  K  V  S  Q  E  Q  S  K  P  P  G<br>421 AAAGAAAAGACTGAAGCCAAAAGGAATAAGGTGTCCCAAGAGCAGAGTAAGCCCCCAGGT<br>161  P  S  G  A  S  T  S  A  A  V  D  H  P  P  L  P  Q  T  S  S<br>481 CCCTCAGGAGCCAGCACATCTGCAGCTGTGGATCATCCCCCACTACCCCAGACCTCATCA<br>181  S  T  P  S  N  T  S  F  T  P  N  Q  E  T  Q  A  Q  R  Q  V<br>541 TCAACTCCATCCAACACTTCGTTTACTCCGAATCAGGAAACCCACGCCCAACGGCAGGTG<br>201  D  A  R  R  N  V  P  Q  N  D  P  V  T  V  V  L  K  A  T<br>601 GATGCAAGAAGAAATGTTCCCCAAAACGACCCAGTGACAGTGGTGGTACTGAAAGCAACA<br>221  A  P  F  K  Y  E  S  P  E  N  G  K  S  T  M  F  H  A  T  V<br>661 GCGCCATTTAAATACGAGTCCCCAGAAAATGGGAAAAGCACAATGTTTCATGCTACAGTG<br>241  A  S  K  T  Q  Y  F  H  V  K  V  F  D  I  N  L  K  E  K  F<br>721 GCCAGTAAGACTCAATATTTCCATGTGAAAGTCTTCCACATCAACTTGAAAGAGAAATTT<br>261  V  R  K  K  V  I  T  I  S  D  Y  F  E  C  K  G  I  L  E  V<br>781 GTAAGGAAGAAGGTCATTACTATATCAGATTACTTTGAATGTAAAGGAATCCTGGAGGTA<br>281  N  E  A  S  S  V  S  E  A  G  I  D  P  K  I  E  V  P  T  R<br>841 AATGAAGCATCATCTGTATCTGAAGCTGGTATTGATCCAAAGATTGAGGTCCCTACCAGA<br>301  I  I  K  R  A  N  Q  T  P  K  I  D  N  L  H  K  Q  A  S  G<br>901 ATTATCAAAAGAGCAAATCAAACTCCCAAGATTGATAATCTTCACAAACAAGCATCGGGA<br>321  T  F  V  Y  G  L  F  V  L  H  Q  K  K  V  N  N  K  N  T  I<br>961 ACATTTGTTTATGGGTTGTTTGTGTTACATCAGAAAAAAGTGAATAACAAGAACACGATC<br>341  Y  E  I  E  D  K  T  G  K  M  D  V  V  G  N  G  K  W  H  N<br>1021 TATGAAATAGAGGATAAAACAGGAAAGATGGATGTAGTGGGGAATGGAAAATGGCACAAT<br>361  I  K  C  E  E  G  D  K  L  R  L  F  C  F  Q  L  R  T  L  D<br>1081 ATCAAGTGTGAGGAAGGAGATAAACTTCGACTCTTCTGCTTTCAATTGAGAACACTTGAC<br>381  K  R  L  K  L  T  C  G  N  H  S  F  I  Q  V  I  K  A  K  K<br>1141 AAGAGGCTGAAACTGACATGTGGAAATCACAGTTTCATTCAGGTCATCAAGGCTAAGAAA<br>401  N  K  E  G  P  M  N  V  -<br>1201 AACAAGGAAGGACCAATGAATGTTAATTGA | SEQ ID NO: 5 |
| WBC020C09_V1.3_AT | No Homology |   1 TCATGATCCTGGGACAATGAGGAGCTGGGAACAGTGGTAGGAACCACGGCAGTGTACCGG<br> 61 TAGGCCTGACTCAGTCACTGGTCCTCAACCTTTAGTGCCTATGAAATGAGCCTCTGGTGA<br>121 GCCCTGCTTTGCCTGACTCAAGGTAGCACTGAGGATCACAGAGGTAATCTTCATAAAGGT<br>181 CTCGTCAGGCTTCCTTCAGAGCTTCACCATGAGGCAGGTTAGGAGCAGGCTCCTGCTGGC<br>241 CCAGAGGAGACCTAGAGTCACAACCCAGGCCCCACACTCCCTCACCCACTTGCTTCCTCT<br>301 CTGAGCAGGGCAGCTACCACCACCCCTCTCAACCTGGGTTCTGCCTTAGAGCGCAGAGTT<br>361 TGCTTCACTCATCTGGTTTCCACAAGGCCTGCAAGATAGGAGTTGTAGTCTTTGCTGTAA<br>421 AAAACTGAGGCTCAAAGAGGTGAAGCGACTVGCCCAAGGGCACACAGCTGGTAAGTAGCA<br>481 TACCTGAGGTGTATCTAACTCCAAAGCCTACATTGTTTAATGACTATGGAGATGCTTCCT<br>541 AGAACCATGGTCCAGATTCTACCTCAAATTCTGCTGCTGCCTTCTCCCTGATGGTTAAA<br>601 ATGACTGATTAGTGCTACTGAGTCCCCATTTAGGAAGAAAACCTTAAGCTAAATATGGTGC<br>661 TTTGAATGGTGGAATCAAGCAATATGGAAAATATGGGGGCCTTTTCTGGCACCTCTGAA<br>721 GTCACTCCACAAAAGTGGCCACCTCCTGTCAAGCTTGGACCTATCACAGCCCAAACCTAG<br>781 ACTCAAATGTGGGGAGICTCCCCTGCCACAGGAGAGCTGCCTGACACACCGTTGTTGCT<br>841 GATGGTAGGCACAGGAAGCAAATGTGGTCTGCACAGGCCCAGCTGGGCCTAGAGGCAGG<br>901 GACTCCCACAGGCCACGGTG | SEQ ID NO: 6 |
| | |   1 GCACAGACAAGGGACTTAAGGCTGGCGAGGGAGAAACCAAAGCCATTCCAGCATGTGTGT<br> 61 CCTTTGTGCTGCCTCTAATCTAAGCTCGGTCAGTTTGTGGGAAGCGACCCTCGAGATTCT<br>121 GATGACAGTTTTGCCACTGAGCCGTGTGAGGCCTGGGACAAGTATTTCTTCTCTGCTTC<br>181 AGTTTTCCTGACTACAGTGTCACCATATCACACTAGAGACAGCCCCTTGTAAAGATCGTG<br>241 TGTTATGAGAAATCAGCAGAGCTGGGGACCCTCAGGCTACACAGCACTGCCCCGTGTATT<br>301 CACAGTGGGAGCACAGAGGCTCTGAACCCTCAGGGACCCGGCCATGCCCACAAAGCCAGG | SEQ ID NO: 7 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 361 ACAGGGACCCAAGTCCTTGGCTACTTGGGCCCTGCCCTTCCCTCTGCTCCACAGAAGGGC<br>421 TACATGATGCTCCTCTGCCTCCCACACACACTCTCCTGGGTGTAGCTGGAGGACAGGAAA<br>481 TAAATCTTTATTGCGTCAGTTTAAAAAAAAAAAAAAAAAAAA | |
| WBC007A05_V1.3_AT | Homo sapiens G protein-coupled receptor 65, mRNA | 1 TTCTTGACTTGATGCAGGCACAGATTTATCAAGCTCCTCAGTCAACAAACACATCACCGG<br>61 AAGAAACATGGAAGGAAAGGAATTTTAAAAAGAGATGTCAATCTCTGTAAAAATAAAGCC<br>121 TTATGTATTCATGTTTGCACTAATCTACTGTGAGATTTATGAAGAAAACAAATTGCGGA<br>181 CAACTCTCTATGTACACTTACAAATGCCTCAGTTGATGCTTGTGGGCTGTTTGTCAGCAT<br>241 TCTGTGACAATGAGCGCATGGACTTCAGCTCATTAAAATCGACTGACCACTTTAGCTAAC<br>301 AGCCAGGAGCCTGGATTCTGACTTCCAACCATCGATATCTGTGTGAAATTGATCTACAC<br>361 CCACCCCTTTAAAAGCATTGATGAATTAATAAGAACTTTTGAAAACAAAGAAAAATGGAAT<br>421 AAATCTTAGTAAAAGAATTGAATGTTGAAAACAAACTACAACGAGGCAAGACTTACTT<br>481 TGCTATTTATCCTCTAAGAACAGATGTAATTGCTACCTTAAAAAGAAAAGATGAACAGCA<br>541 CATGTATTGAAGAACAGCATGACCTGGATCACTATTTGTTTCCGATTGTCTACGTCATTG<br>601 TGGTCATAGTCAGCATTCCAGCCAATATTGGATCTCTCTGTGTGTCTTTTCTGCAAGTAA<br>661 AAAAGGAAAATGAATTGGGAATTTACCTCTTCAGTTTATCACTGTCAGATCTGCTGTATA<br>721 CATTAACTCTCCCTCTATGGATTGATTATACTTGGAATAAAGACAACTGGACTTTCTCTC<br>781 CTGCCTTGTGCAAAGGGAGTGCTTTTCTCATGTACATGAATTTTTACAGCAGCACAGCAT<br>841 TCCTCACCTGCATTGCCGTTGATCGGTATTTGGCTGTTGTCTACCCTTTGAAGTTTTTTT<br>901 TCCTAAGGACAAGAAGATTTGCACTCATGGTCAGCCTGTCCATCTGGATATTGGAAACCA<br>961 TCTTCAATGCTGTCATGTTGTGGGAAGATGAAACAGTTGTTGAATATTGCGATGCCGAAA<br>1021 AGTCTAATTTTACTTTATGCTATGACAAATACCCTTTAGAGAAATGGCAAATCAACCTCA<br>1081 ACTTGTTTAGAACGTGTGCATGCTATGCCATACCTCTGGTCATCATAATGGTTTGCAACC<br>1141 TGAAGGTCTACCAAGCTGTGCAGCATAATCGAGCCACGGAAGACAGTGAAAAGAAGAGAA<br>1201 TCATAAAACTACTTGTTAGTATCACATTGACTTTTATCTTGTGTTTTACTCCCTTTCATG<br>1261 TGATGTTGCTGATTCGCTGCATTCTAGAGCATGCTGTGAACTTCGAAGACCACAGCAATT<br>1321 CTGGGAAGCGAACTTACACAATGTATAGAATCACGGTTGCTTTAACAAGCTTAAATTGTG<br>1381 TTGCGGATCCAATTCTGTACTGTTTTGTGACTGAAACAGGAAGATCTGATATGTGGAATG<br>1441 TACTAAAATTCTGTACTGGGAGGCTCAACACATCACAGAAACAGAAAAAACGCATACCGT<br>1501 CTATGTCTACAAAAGATACTGTAGAATTAGAGGTCCTTGAGTAGAACCAAGGATGTTTTG<br>1561 AAGGGAAGGGAAGTTTAAGTTATGCATTATTATATCACCAAGATTGCGTTTTGAAAAGGA<br>1621 AATCTAGCATGTGAGGGGACTAAGTGTTCTCAGAGTGATGTTTTAATCCAGTCCAATAAA<br>1681 AATATCTTAAAACTGCATTGTACAGCTCCCTCCCTGCGTTTTATTAAATGATGTATATTA<br>1741 AACAAAGATCAATAAAAAAAAAAAAAAAAAAAAAAAAAAAAAA | SEQ ID NO: 8 |
| | |   1 M N S T C I E E Q H D L D H Y L F P I V<br>  1 ATGAACAGCACATGTATTGAAGAACAGCATGACCTGGATCACTATTTGTTTCCGATTGTC<br> 21 Y V I V V I S P A N I G S L C V S F<br> 61 TACGTCATTGTGGTCATAGTCAGCATTCCAGCCAATATTGGATCTCTCTGTGTGTCTTTT<br> 41 L Q V K K E N E L G I Y L F S L S L S D<br>121 CTGCAAGTAAAAAGGAAAATGAATTGGGAATTTACCTCTTCAGTTTATCACTGTCAGAT<br> 61 L L Y T L T L P L W I D Y T W N K D N W<br>181 CTGCTATACATTAACTCTCCCTCTATGGATTGATTATACTTGGAATAAAGACAACTGG<br> 81 T F S P A L C K G S A F L M Y M N F Y S<br>241 ACTTTCTCTCCTGCCTTGTGCAAAGGGAGTGCTTTTCTCATGTACATGAATTTTTACAGC<br>101 S T A F L T C I A V D R Y L A V V Y P L<br>301 AGCACAGCATTCCTCACCTGCATTGCCGTTGATCGGTATTTGGCTGTTGTCTACCCTTTG<br>121 K F F L R T R R F A L M V S L S I W I<br>361 AAGTTTTTTTTCCTAACGACAAGAAGATTTGCACTCATGGTCAGCCTGTCCATCTGGATA<br>141 L E T I F N A V M L W E D E T V V E Y C<br>421 TTGGAAACCATCTTCAATGCTGTCATGTTGTGGGAAGATGAAACAGTTGTTGAATATTGC<br>161 D A E K S N F T L C Y D K Y P L E K W Q<br>481 GATGCCGAAAAGTCTAATTTTACTTTATGCTATGACAAATACCCTTTAGAGAAATGGCAA<br>181 I N L N L F R T C A C Y A I P L V I I M<br>541 ATCAACCTCAACTTGTTTAGAACGTGTGCATGCTATGCCATACCTCTGGTCATCATAATG<br>201 V C N L K V Y Q A V Q H N R A T E D S E<br>601 GTTTGCAACCTGAAGGTCTACCAAGCTGTGCAGCATAATCGAGCCACGGAAGACAGTGAA<br>221 K K R I I K L L V S I T L T F I L C F T<br>661 AAGAAGAGAATCATAAAACTACTTGTTAGTATCACATTGACTTTTATCTTGTGTTTTACT<br>241 P F H V M L L I R C I L E H A V N F E D<br>721 CCCTTTCATGTGATGTTGCTGATTCGCTGCATTCTAGAGCATGCTGTGAACTTCGAAGAC<br>261 H S N S G K R T Y T M Y R I T V A L T S<br>781 CACAGCAATTCTGGGAAGCGAACTTACACAATGTATAGAATCACGGTTGCTTTAACAAGC<br>281 L N C V A D P I L Y C F V T E T G R S D<br>841 TTAAATTGTGTTGCGGATCCAATTCTGTACGTTTTGTGACTGAAACAGGAAGATCTGAT<br>301 M W N V L K F C T G R L N T S Q R Q R K<br>901 ATGTGGAATGTACTAAAATTCTGTACTGGGAGGCTCAACACATCACAAGACAAAGAAAA<br>321 R I P S M S T K D T V E L E V L E -<br>961 CGCATACCGTCTATGTCTACAAAAGATACTGTAGAATTAGAGGTCCTTGAGTAG | SEQ ID NO: 9 |

TABLE 1-continued

| Gene | GenBank Homology | DNA SEQUENCE/DEDUCED AMINO ACID SEQUENCE | SEQUENCE IDENTIFIER: |
|---|---|---|---|
| B1961581 | *Homo sapiens* NAD kinase ACCESSION BC001709 | 1 GTAGACGTGGCGGGCGGACCCGGGGGCGCCCTCCGGACGCGGCAGGCATCAGTGTTTTTC<br>61 TGACCGAAGTTCTCATTTCCTGACAATGGAAATGGAACAAGAAAAAATGACCATGAATAA<br>121 GGAATTGAGTCCAGACGCGGCTGCTTACTGCTGCTCGGCCTGCCACGGCGATGAGACCTG<br>181 GAGTTACAACCACCCCATCCGGGGCCGGGCCAAGTCTCGCAGCCTGTCTGCCTCGCCCGC<br>241 CCTGGGGAGCACCAAGGAGTTCAGGAGGACACGCTCTCTTCATGGGCCATGCCCGGTGAC<br>301 CACTTTTGGACCAAAGGCCTGTGTGCTGCAGAACCCCCAGACCATCATGCACATTCAGGA<br>361 CCCCGCGAGCCAGCCGGCTGACGTGGAACAAGTCCCCAAAGAGCGTCCTTGTCATCAAGAA<br>421 GATGAGAGATGCCAGCCTACTGCAGCCGTTCAAGGAGCTCTGCACGCACCTCATGGAGGA<br>481 GAACATGATCGTGTATGTGGAAAAGAAAGTGCTAGAAGACCCTGCCATCGCCAGCGATGA<br>541 AAGCTTTGGGGCAGTGAAGAAGAAATTCTGTACCTTTCGAGAAGATTATGATGACATTTC<br>601 CAATCAGATAGACTTCATCATCTGCCTTGGGGGGGAGACGGGACGCTGCTGTACGCTTCCTC<br>661 GCTTTTCCAGGGCAGCGTCCCTCCGGTCATGGCCTTCCACCTGGGCTCCCTGGGCTTCCT<br>721 GACCCCATTCAGCTTTGAGAACTTCAGTCCCAAGTTACTCAGGTGATAGAGGGGAACGC<br>781 AGCTGTTGTTCTCCGGAGTCGGCTGAAGGTCAGGGTGGTGAAGGAGCTCCGGGGGAAGAA<br>841 GACGGCCGTGCACAATGGGCTGGGTGAGAAAGGCTCGCAGGCTGCAGGCCTGGACATGGA<br>901 TGTCGGGAAGCAGGCCATGCAGTACCAGGTCCTGAATGAGGTGGTGATTGACAGAGGCCC<br>961 CTCCTCCTACCTGTCCAATGTGGATGTCTACCTGGACGGACACCTCATCACCACGGTGCA<br>1021 GGGCGACGGAGTGATCGTGTCCACCCCGACGGGCAGCACGGCGTATGCGGCCGCGGCCGG<br>1081 GGCCTCCATGATCCACCCCAACGTGCCGGCCATCATGATCACGCCCATCTGCCCCCACTC<br>1141 GCTGTCCTTCCGGCCCATCGTGGTCCCCGCAGGGGTCGAGCTGAAGATCATGCTGTCACC<br>1201 TGAAGCAAGGAACACAGCATGGGTGTCCTTTGATGGACGGAAGAGACAAGAGATCCGCCA<br>1261 TGGAGACAGCATCAGCATCACTACCTCATGCTACCCGCTCCCCTCCATCGTGTGCGGGA<br>1321 CCCCGTGAGCGACTGGTTTGAGAGCCTCGCCCAGTGCCTGCATTGGAACGTCCGGAAGAA<br>1381 GCAAGCCCACTTCGAGGAGGAGGAGGAGGAGGAGGAGGAGGCTAGGTCAAGCCCCTATC<br>1441 CAGGCCCGAATCCTTCCGCTGCCCTCCAAGCGCCCTCTGGGGACAGACCAATCTGCGTGT<br>1501 GTCTGTGACCGCCTGTCTCAGTGGCACGGCCACTTCCTTTCGTAGCTGGGTTAGAGCCT<br>1561 GGGTCTGCCTTTTGTCCAGATCAGCTGTTTTTTTAAAATGTCTGACTTTTTTGCATTTC<br>1621 TAAAGAAGCGTGAGAAATGGGCTGGGAGTGCTTCTGTCCTGCTGACACCCCGCGGTGGGT<br>1681 CCCTGGAGCGCGGCCTCCAGCTGCCGCAATTTCCATGCCAGGATATTTTCCGCAAATCA<br>1741 GTCGGTTGAAATTCAGAGGAGTCAGAATGACTCGACCTGTCCTTCAATGTTGATAATAAA<br>1801 TGTCTCAGCCCAAAAACCTTCCTTGAGCTGCCATGCTTTTCCCCTTTGACCTGCACCTCTTC<br>1861 CCCTAAAACTTCTGCAGGGAAGCCCCTGGCGGAGGCGCCATTGAAAGCATGGTCTTGCCA<br>1921 GTGGCTGGCAAGGCGGTTTTGTTCTGCTCAGTTTCTGGAGAGGGTTGGATGCGTCCCCTG<br>1981 CCATCCAGCCCTCCCCGCTTGAGGCCAGCACTGAGTCTGGGACACTCAGCGGGAAGGGGG<br>2041 CTGGCATCGCCAGCGACCCACACATTCCTCACGTAGCTTCTGCTCCCAGGAAGGTAGTTT<br>2101 AAATCCTGTATATACTTTTTAGAGACTCTTTTAAACTTTCTGAAGTGCTGATGTACATAC<br>2161 TTTCTCGTACACACTTTTGTGAAGATTTCAAGGGGAAGGAGTTGTCTGCCATTCAATGT<br>2221 TTACATTTATGTTCTGCAAGACGCTGTCCTCAGGGACCATTAGGGGACCATTCTGTTCAG<br>2281 TGCGACCCTGATGGTCCGGGAGATGAGGGTTTCCGGGGCTAGTGATCGTGATCCCTTTTA<br>2341 TTTGCAACTGTAATGAGAATTTTTCACACTAACACAGCGAGGGACTCAACACGCTGATTC<br>2401 TCCTCCTGCCTCTCCCGTGAGTCTTCCAGCCTGCCCAGCACCAGCAGCTGTGGAGCACGTG<br>2461 GATGCTGCCTACCCCGGCGCCCGCGTCTTCCACGGGCACAGGTGTGTGGAGGCCGTGGTC<br>2521 GGACCCTGGTGTCCTGGTTACTGCTGCCCGGGTGTCTTTTTTTTGAGTAACTGCTCTCTG<br>2581 AGTTTTGCACACGAAGTTGCCCTCATCTGCTGGAGATCGATAAGGAAGGCACAAGACGTT<br>2641 CTCCTCTGCCCGTGAGGAGCTTCCCGCAGCCGCCTGGCCCAGCCTGGCACGTTCTCCGA<br>2701 GGCATGTGTCTCCCTGCTCACCCTCGTCTGGGCACCTCAGCATCTGTGGACTTGAGCGTC<br>2761 CAAAAACCCTGAGTGTGATTCTGGGCAGCCGGCTGGCTTGAAGTCCGCCATGACCCTGG<br>2821 GCACAGGGGAAGCCCAGCCGTGGGCTTAGGAGAGGGGACCAGCGCCCAGCGTTAGGGCT<br>2881 GGAAGACGGCAGTGTTCAGAATTCCAGCCGCTCATCTGAACACAGAAGGTGTGAACTGAC<br>2941 CTCTAAAGCAGCGTGAGATGGGAATGATCTAGAAAACTTTGGATTTTTGAAGTAAATTTT<br>3001 AATGTTTCATATTAATTTCTTGAAAATGTATTAAATGTCATTGAAAGCCTTATTACGCTT<br>3061 TTCAGATCCTTTCAATAAACAAGACTTGTAGAAAAAAAAAAAAAAAAAAAAAAAAAAAA<br>3121 AAAAAAAAAAAAAAAAAAAAA | SEQ ID NO: 10 |
| | | 1 MEMEQEKMTMNKELSPDAAAYCCSACHGDETWSYNHPIRGRAKSRSLSASPALGSTKEFR<br>61 RTRSLHGPCPVTTFGPKACVLQNPQTIMHIQDPASQRLTWNKSPKSVLVIKKMRDASLLQ<br>121 PFKELCTHLMEENMIVYVEKKVLEDPAIASDESFGAVKKKFCTFREDYDDISNQIDFIIC<br>181 LGGDGTLLYASSLFQGSVPPVMAFHLGSLGFLTPFSFENFQSQVTQVIEGNAAVVLRSRL<br>241 KVRVVKELRGKKTAVHNGLGEKGSQAAGLDMDVGKQAMQYQVLNEVVIDRGPSSYLSNVD<br>301 VYLDGHLITTVQGDGVIVSTPTGSTAYAAAAGASMIHPNVPAIMITPICPHSLSFRPIVV<br>361 PAGVELKIMLSPEARNTAWVSFDGRKRQEIRHGDSISITTSCYPLPSICVRDPVSDWFES<br>421 LAQCLEWNVRKKQAHFEEEEEEEEG- | SEQ ID NO: 11 |
| BM735170.V1.3_AT | No Homology | 1 TCGTCCTCACTGTTTTTACCTTGACTTCAACTGCCCACCCATTCAGCTGAGCAGCTGGGG<br>61 ATGACTGGTTTTTTTCTGTCATTATTTACATATATTTGCTGGAGCTGATTACTGAACTCG<br>121 TATTTAATCTCTATTGCCAGTGAAATGTTACATTATTTTTCTGATTGGTTTCCCCTCTTA<br>181 TTGGAAGTATAATTCCAGCAATGTTAGTAGGATAGAAAAGGAGGGAATCATTTGAGGCTT<br>241 TCAGGTTAGCAAGAGCTATGGGCGTTACATGCTTGTTTTTTCCAAGCAGCTAATTTTTAT<br>301 CTACTTCTCAGATTAGGTTTGGGGGAGCTTTGGCATCTTTTTAGATTTTAATCTCTATTT<br>361 TCTTAATCCAGGGTACAAATGTGAGCAAAAGAAAAAAGAAATCTTTTATACTTTTTTAA<br>421 ATAAATTTATAAATAAATTTTGAGCTGCTTCGGT | SEQ ID NO: 12 |

TABLE 1-continued

| Gene | GenBank Homology | DNA SEQUENCE/DEDUCED AMINO ACID SEQUENCE | SEQUENCE IDENTIFIER: |
|---|---|---|---|
| WBC010C05 | *Bos taurus* similar to hypothetical protein BC012928 (LOC529385) | <1 ATTTCTGCTCCTAATGAATTTGATCTTATGTTCACACTGGAGGTTCCCCGAATTCAGCTG<br>61 GAAGAATATTGCCACAATACTGATGTCATTATGGAGAGGAAGAAAAGAGGGAGCCCTGCT<br>121 GTAACACTTCTGATTAGAAAACCTAGAGAAATATCTGTGGATATAATCCTGGCTTTGGAG<br>181 TCAAAAAGCAGCTGGCCTGCTAGCACCCAGAAAGGCCTGCCCATCAGTAACTGGCTTGGA<br>241 ACAAAAGTTAAGGACAATCTAAAACGACAGCCATTTTACCTGGTACCCAAGCACGCAAAG<br>301 GAAGGAAGTCTTTTCCAAGAAGAAACATGGCGGCTGTCCTTCTCTCACATTGAAAAGGCC<br>361 ATTTTGACAAATCATGGACAAACTAAAACATGCTGTGAAACTGAAGGAGTAAAATGTTGC<br>421 AGGAAAGAGTGTTTAAAGCTGATGAAATACCTTTTAGAACAACTGAAAAAAAAGTTTGGA<br>481 AAGCAAAGGGGACTGGATAAGTTCTGTTCTTATCATGTGAAGACTGCCTTCCTTCATGTC<br>541 TGTACCCAGAACCCGCATGACAGTTGGTGGCTCTACAAAGACCTGGAGCTCTGCTTTGAT<br>601 AACTGTGTGACATACTTTCTTCAGTGTCTCAAGACAGAACCCTTGAGCACTATTTCATT<br>661 CCTGATGTCAATCTCTTCTCTCGAGACGAAATTGGCAAGCCAAGTAAAGAATTTCTGTCA<br>721 AAGCAAATTGAATATGAGCAAAACAATGGATTTCCGGTTTTTGATGAGTTTTGA<br><br><1     I  S  A  P  N  E  F  D  L  M  F  T  L  E  V  P  R  I  Q  L<br>1 ATTTCTGCTCCTAATGAATTTGATCTTATGTTCACACTGGAGGTTCCCCGAATTCAGCTG<br>21    E  E  Y  C  H  N  T  D  V  I  M  E  R  K  K  R  G  S  P  A<br>61 GAAGAATATTGCCACAATACTGATGTCATTATGGAGAGGAAGAAAAGAGGGAGCCCTGCT<br>41    V  T  L  L  I  R  K  P  R  E  I  S  V  D  I  I  L  A  L  E<br>121 GTAACACTTCTGATTAGAAAACCTAGAGAAATATCTGTGGATATAATCCTGGCTTTGGAG<br>61    S  K  S  S  W  P  A  S  T  Q  K  G  L  P  I  S  N  W  L  G<br>181 TCAAAAAGCAGCTGGCCTGCTAGCACCCAGAAAGGCCTGCCCATCAGTAACTGGCTTGGA<br>81    T  K  V  K  D  N  L  K  R  Q  P  F  Y  L  V  P  K  H  A  K<br>241 ACAAAAGTTAAGGACAATCTAAAACGACAGCCATTTTACCTGGTACCCAAGCACGCAAAG<br>101   E  G  S  L  F  Q  E  E  T  W  R  L  S  F  S  H  I  E  K  A<br>301 GAAGGAAGTCTTTTCCAAGAAGAAACATGGCGGCTGTCCTTCTCTCACATTGAAAAGGCC<br>121   I  L  T  N  H  G  Q  T  K  T  C  C  E  T  E  G  V  K  C  C<br>361 ATTTTGACAAATCATGGACAAACTAAAACATGCTGTGAAACTGAAGGAGTAAAATGTTGC<br>141   R  K  E  C  L  K  L  M  K  Y  L  L  E  Q  L  K  K  K  F  G<br>421 AGGAAAGAGTGTTTAAAGCTGATGAAATACCTTTTAGAACAACTGAAAAAAAAGTTTGGA<br>161   K  Q  R  G  L  D  K  F  C  S  Y  H  V  K  T  A  F  L  H  V<br>481 AAGCAAAGGGGACTGGATAAGTTCTGTTCTTATCATGTGAAGACTGCCTTCCTTCATGTC<br>181   C  T  Q  N  P  H  D  S  W  W  L  Y  K  D  L  E  L  C  F  D<br>541 TGTACCCAGAACCCGCATGACAGTTGGTGGCTCTACAAAGACCTGGAGCTCTGCTTTGAT<br>201   N  C  V  T  Y  F  L  Q  C  L  K  T  E  H  L  E  H  Y  F  I<br>601 AACTGTGTGACATACTTTCTTCAGTGTCTCAAGACAGAACCCTTGAGCACTATTTCATT<br>221   P  D  V  N  L  F  S  K  D  E  I  G  K  P  S  K  E  F  L  S<br>661 CCTGATGTCAATCTCTTCTCTCGAGACGAAATTGGCAAGCCAAGTAAAGAATTTCTGTCA<br>241   K  Q  I  E  Y  E  Q  N  N  G  F  P  V  F  D  E  F  -<br>721 AAGCAAATTGAATATGAGCAAAACAATGGATTTCCGGTTTTTGATGAGTTTTGA | SEQ ID NO: 13<br><br><br><br><br><br><br><br><br><br><br><br>SEQ ID NO: 14 |
| WBC009D04_V1.3_AT | Human mRNA of X-CGD gene involved in chronic granulomatous disease located on chromosome X. | 1 CTTCCTCTGCCACCATCGGGGAACTGGGCTGTGAATGAGGGGCTCTCCATTTTTGCTATT<br>61 CTGGTTTGGCTGGGGTTGAACGTCTTCCTCTTTGTCTGGTATTACCGGGTTTATGATATT<br>121 CCACCTAAGTTCTTTTACACAAGAAAACTTCTTGGGTCAGCACTGGCACTGGCCAGGGCC<br>181 CCTGCAGCCTGCCTGAATTTCAACTGAATGCTGATTCTCTTGCCAGTCTGTCGAAATCTG<br>241 CTGTCCTTCCTCAGGGGTTCCAGTGCGTGCTGCTCAACAAGAGTTCGAAGCAACTGGAC<br>301 AGGAATCTCACCTTTCATAAAATGGTGGCATGGATGATTGCACTTCACTCTGCGATTCAC<br>361 ACCATTGCACATCTATTTAATGTGGAAATGGTGTGTGAATGCCCGAGTCAATAATTCTGAT<br>421 CCTTATTCAGTAGCACTCTCTGAACTTGGAGACAGGCAAAATGAAAGTTATCTCAATTTT<br>481 GCTCGAAAGAGAATAAAGAACCCTGAAGGAGGCCTGTACCTGGCTGTGACCCTGTTGGCA<br>541 GGCATCACTGGAGTTGTCATCACGCTGTGCCTCATATTAATTATCACTTCCTCCACCAAA<br>601 ACCATCCGGAGGTCTTACTTTGAAGTCTTTTGGTACACACATCATCTCTTTGTGATCTTC<br>661 TTCATTGGCCTTGCCACCCATGGAGCTGAACGAATTGTACGTGGGCAGACCGCAGAGAGT<br>721 TTGGCTGTGCATAATATAACAGTTTGTGAACAAAAAATCTCAGAATGGGGAAAAATAAAG<br>781 GAATGCCCAATCCCTCAGTTTGCTGGAAACCCTCCTATGACTTGGAAATGGATAGTGGGT<br>901 GTCATCACCAAGGTGGTCACTCACCCTTTCAAACCATCGAGCTACAGATGAAGAAGAAG<br>961 GGGTTCAAAATGGAAGTGGGACAATACATTTTTGTCAAGTGCCCAAAGGTGTCCAAGCTG<br>1021 GAGTGGCACCCTTTTACACTGACATCCGCCCCTGAGGAAGACTTCTTTAGTATCCATATC<br>1081 CGCATCGTTGGGGACTGGACAGAGGGGCTGTTCAATGCTTGTGCCTGTGATAAGCAGGAG<br>1141 TTTCAAGATGCGTGGAAACTACCTAAGATAGCGGTTGATGGGCCCTTTGGCACTGCCAGT<br>1201 GAAGATGTGTTCAGCTATGAGGTGGTGATGTTAGTGGGAGCAGGGATTGGGGTCACACCC<br>1261 TTCGCATCCATTCTCAAGTCAGTCTGGTACAAATATTGCAATAACGCCACCAATCTGAAG<br>1321 CTCAAAAAGATCTACTTCTACTGGCTGTGCCGGGACACACATGCCTTTGAGTGGTTTGCA<br>1381 GATCTGCTGCAACTGCTGGAGAGCCAGATGCAGGAAAGGAACAATGCCGGCTTCCTCAGC<br>1441 TACAACATCTACCTCACTGGCTGGGATGAGTCTCAGGCCAATCACTTTGCTGTGCACCAT<br>1501 GATGAGGAGAAAGATGTGATCACAGGCCTGAAACAAAAGACTTTGTATGGACGGCCCAAC<br>1561 TGGGATAATGAATTCAAGACAATTGCAAGTCAACACCCTAATACCAGAATAGGAGTTTTC<br>1621 CTCTGTGGACCTGAAGCTTGGCTGAAACCCTGAGTAAACAAAGCATCTCCAACTCTGAG<br>1681 TCTGGCCTCCGGGGAGTGCATTTCATTTTCAACAAGGAAAACTTCTAACTTGTCTCTTCC<br>1741 ATGAGGAAATAAATGTGGGTTGTGCTGCCAAATGCTCAAATAATGCTAATTGATAATATA<br>1801 AATACCCCTGCTTAAAAGTGGACAAAAAGAACTATAATGTAATGGTTTTCCCTTAAAG<br>1861 GAATGTCAAAGATTGTTTGATAGTGATAAGTTACATTTATGTGGAGCTCTATGGTTTTGA<br>1921 GAGCACTTTTACAAACATTATTTCATTTTTTCCTCTCAGTAATGTCAGTGGAAGTTAGG<br>1981 GAAAAGATTCTTGGACTCAATTTTAGAATCAAAAGGGAAAGGATCAAAAGGTTCAGTAAC | SEQ ID NO: 15 |

TABLE 1-continued

| Gene | GenBank Homology | DNA SEQUENCE/DEDUCED AMINO ACID SEQUENCE | SEQUENCE IDENTIFIER: |
|------|------------------|------------------------------------------|----------------------|
| | | 2041 TTCCCTAAGATTATGAAACTGTGACCAGATCTAGCCCATCTTACTCCAGGTTTGATACTC<br>2101 TTTCCACAATACTGAGCTGCCTCAGAATCCTCAAAATCAGTTTTTATATTCCCCAAAAGA<br>2161 AGAAGGAAACCAAGGAGTAGCTATATATTTCTACTTTGTGTCATTTTTGCCATCATTATT<br>2221 ATCATACTGAAGGAATTTTCCAGATCATTAGGACATAATACATGTAAGAGAGTGTCTCAA<br>2281 CACTTATTAGTGACAGTATTGACATCTGAGCATACTCCAGTTTACTAATACAGCAGGGTA<br>2341 ACTGGGCCAGATGTTCTTTCTACAGAAGAATATTGGATTGATTGGAGTTAATGTAATACT<br>2401 CATCATTTACCACTGTGCTTGGCAGAGAGCGGATACTCAAGTAAGTTTTGTTAAATGAAT<br>2461 GAATGAATTTAGAACCATGCAATGCCAGGGTAGAATTAATTTAAGGCCTTAAAGAGAAAT<br>2521 ATCTAAGGAAATAACTTCTGTTACTCTTACAGACCAAAGGAACCCGATTCTTCTGACAGT<br>2581 AGAGAACAGGCTAAAGATAGTAACCAATAGGATGTCCTGGAGGTTCCCTCACATTCTTGT<br>2641 TTGAAGCATGGAGGAAAGGGATGGAGGCAGAGAATGGACCTCCTACCATAACTGGCTG<br>2701 GCTCCTCTAGTCCTGCTCCCCGTGCCATGAAAGAAATGCAAACTGATTTACTGCCTGAAA<br>2761 GGGTCTCCTCCAGCCAGCACTTGTGAATTTGAAATTAAGAATTGTGACAAATATGTGTCT<br>2821 GATATGCCCATCTGCTTTAAATAGCATCCACCCCTTGTTTTACTTAAATACACACACAAA<br>2881 ATGGATCGCATCTGTGTGACTAATGGTTTATTTGTATTATATCATCATCATCCTAAA<br>2941 ATTAACAACCCAGAAACAAAAATCTCTATACAGAGATCAAATTCACACTCAATAGTATGT<br>3001 TCTGAATATATGTTCAAGAGAGTCTCTAAATCACTGTTAGTGTGGCCAAGAGCAGGGT<br>3061 TTTCTTTTTGTTCTTAGAACTGCTCTTATTTCTGGGAACTATAAACAGATTTGTTGGCCC<br>3121 CACCCTCTGGAACCACAGATATTTAGAGCTATTTAAATTTGGTAATGCGGAAGAAGGAGA<br>3181 AAGAGCTGGGGAAGGGCAGAAGACTGGTTTAGGAGGAAAGGAAATAAGGAGAAAAGAG<br>3241 AATGGGAGAGTGAGAGAAAATAAAAAAGGCAAAGGGAGAGAGAGGGGAAGGGGGTCTCA<br>3301 TATTGGTCATTCCCTGCCCCAGATTTCTTAAAGTTTGATATGTATAGAATATAATTGAAG<br>3361 GAGGTATACACATACTGATGTTGTTTTGATTATCTATGGTATTGAATCTTTTAAAATCTG<br>3421 GTCACAAATTTTGATGCTGAGGGGGATTATTCAAGGGACTAGGATGAACTAAATAAGAAC<br>3481 TCAGTTGTTCTTTGTCATACTACTATTCCTTTCGTCTCCCAGAATCCTCAGGGCACTGAG<br>3541 GGTAGGTCTGACAATAAGGCCTGCTGTGCGAAAAATAGCCTTTCTGAAATGTACCAGGAT<br>3601 GGTTTCTGCTTATAGACACTTAGGTCCAGCCTGTTCACACTGCACCTCGAGTATCAGTTC<br>3661 ATTCATTCAACAAATTTTTATTGTGCTGTTACCATGACTCACGCTCTGTTTATTGTTTCA<br>3721 ATTCTTTACACCAAGTATGAACTGGAGAGGGAAACCTCAGTTATAAGGAGCCTGAGAATC<br>3781 TTGGTCCCTCCAACCTATGTGGCCCAAGTAAAACCAACTCCATTTGTTGCTCTGAAAATG<br>3841 TTTCTCCAGGGTTTTCTATCTTCAAAACCAACTAAGTTATGAAAGTAGAGAGATCTGCCC<br>3901 TGTGTTATCCAGTTATGAGATAAAAAATGAGTATAAAAGTGCTTGTCATTATAAAAGTTT<br>3961 CCTTTTTATCTCTCAAGCCACCAGCTGCCAGCCACCACGAGCCAGCTGCCAGCCTAGCTT<br>4021 TTTTTTTTTTTTTTTTTAGCACTTAGCATTTAGCATTTAGTAACAGGTACTGAGAGAA<br>4081 CGATTAAGCATTGTTTTAATCTCAAGGCTATGAAGGCTTTTTTAGTTCTCCTGCTTTT<br>4141 GCAATATTGCGTTTATGAAATTTGAATGCTTGTAGGTGTTGTGTGTGAATAATTTTGGG<br>4201 GGCCTGGGAGATATTCCTAGGAAGAACTATTAAAATTGTGCTCAACTATTAAAATGAATG<br>4261 AGCTTTC<br><br>   1  M  L  I  L  L  P  V  C  R  N  L  L  S  F  L  R  G  S  S  A<br>   1 ATGCTGATTCTCTTGCCAGTCTGTCGAAATCTGCTGTCCTTCCTCAGGGGTTCCAGTGCG<br>  21  C  C  S  T  R  V  R  R  Q  L  D  R  N  L  T  F  H  K  M  V<br>  61 TGCTGCTCAACAAGAGTTCGAAGACAACTGGACAGGAATCTCACCTTTCATAAAATGGTG<br>  41  A  W  M  I  A  L  H  S  A  I  H  T  I  A  H  L  F  N  V  E<br> 121 GCATGGATGATTGCACTTCACTCTGCGATTCACACCATTGCACATCTATTTAATGTGGAA<br>  61  W  C  V  N  A  R  V  N  N  S  D  P  Y  S  V  A  L  S  E  L<br> 181 TGGTGTGTGAATGCCCGAGTCAATAATTCTGATCCTTATTCAGTAGCACTCTCTGAACTT<br>  81  G  D  R  Q  N  E  S  Y  L  N  F  A  R  K  R  I  K  N  P  E<br> 241 GGAGACAGGCAAAATGAAAGTTATCTCAATTTTGCTCGAAAGAGAATAAAGAACCCTGAA<br> 101  G  G  L  Y  L  A  V  T  L  L  A  G  I  T  G  V  V  I  T  L<br> 301 GGAGGCCTGTACCTGGCTGTGACCCTGTTGGCAGGCATCACTGGAGTTGTCATCACGCTG<br> 121  C  L  I  L  I  I  T  S  S  T  K  T  I  R  R  S  Y  F  E  V<br> 361 TCCCTCATATTAATTATCACTTCCTCCACCAAAACCATCCGGAGGTCTTACTTTGAAGTC<br> 141  F  W  Y  T  H  H  L  F  V  I  F  F  I  G  L  A  I  H  G  A<br> 421 TTTTGGTACACACAVCATCTCTTTGTGATCTTCTTCATTGGCCTTGCCATCCATGGAGCT<br> 161  E  R  I  V  R  G  Q  T  A  E  S  L  A  V  E  N  I  T  V  C<br> 481 GAACGAATTGTACGTGGGCAGACCGCAGAGAGTTTGGCTGTGCAVAAVATAACAGTTTGT<br> 181  E  Q  K  I  S  E  W  G  K  I  K  E  C  P  I  P  Q  F  A  G<br> 541 GAACAAAAAATCTCAGAATGGGGAAAATAAAGGAATGCCCAATCCCTCAGTTTGCTGGA<br> 201  N  P  P  M  T  W  K  W  I  V  G  P  M  F  L  Y  L  C  E  R<br> 601 AACCCTCCTATGACTTGGAAATGGATAGTGGGTCCCATGTTTCTGTATCTCTGTGAGAGG<br> 221  L  V  R  F  W  R  S  Q  Q  K  V  V  I  T  K  V  V  T  H  P<br> 661 TTGGTGCGGTTTTGGCGATCTCAACAGAAGGTGGTCATCACCAAGGTGGTCACTCACCCT<br> 241  F  K  T  I  E  L  Q  M  K  K  K  G  F  K  M  E  V  G  Q  Y<br> 721 TTCAAAACCATCGAGCTACAGATGAAGAAGAAGGGGTTCAAAATGGAAGTGGGACAATAC<br> 261  I  F  V  K  C  P  K  V  S  K  L  E  W  H  P  F  T  L  T  S<br> 781 ATTTTTGTCAAGTCCCCAAAGGTGTCCAAGCTGGAGTGGCACCCTTTTACACTGACATCC<br> 281  A  P  E  E  D  F  S  I  H  I  R  I  V  G  D  W  T  E  G<br> 841 GCCCCTGAGGAAGACTTCTTTAGTATCCATATCCGCATCGTTGGGGACTGGACAGAGGGG<br> 301  L  F  N  A  C  G  C  D  K  Q  E  F  Q  D  A  W  K  L  P  K<br> 901 CTGTTCAATGCTTGTGGCTGTGATAAGCAGGAGTTTCAAGATGCGTGGAAACTACCTAAG<br> 321  I  A  V  D  G  P  F  G  T  A  S  E  D  V  F  S  Y  E  V  V<br> 961 ATAGCGGTTGATGGGCCCTTTGGCACTGCCAGTGAAGATGTGTTCAGCTATGAGGTGGTG | SEQ ID NO: 16 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 341 M L V G A G I G V T P F A S I L K S V W<br>1021 ATGTTAGTGGGAGCAGGGATTGGGGTCACACCCTTCGCATCCATTCTCAAGTCAGTCTGG<br>361 Y K Y C N N A T N L K L K K I Y F Y W L<br>1081 TACAAATATTGCAATAACGCCACCAATCTGAAGCTCAAAAAGATCTACTTCTACTGGCTG<br>381 C R D T H A F E W F A D L L Q L L E S Q<br>1141 TGCCGGGACACACATGCCTTTGAGTGGTTTGCAGATCTGCTGCAACTGCTGGAGAGCCAG<br>401 M Q E R N N A G F L S Y N I Y L T G W D<br>1201 ATGCAGGAAAGGAACAATGCCGGCTTCCTCAGCTACAACATCTACCTCACTGGCTGGGAT<br>421 E S Q A N H F A V H H D E E K D V I T G<br>1261 GAGTCTCAGGCCAATCACTTTGCTGTGCACCATGATGAGGAGAAAGATGTGATCACAGGC<br>441 L K Q K T L Y G R P N W D N E F K T I A<br>1321 CTGAAACAAAAGACTTTGTATGGACGGCCCAACTGGGATAATGAATTCAAGACAATTGCA<br>461 S Q H P N T R I G V F L C G P E A L A E<br>1381 AGTCAACACCCTAATACCAGAATAGGAGTTTTCCTCTGTGGACCTGAAGCCTTGGCTGAA<br>481 T L S K Q S I S N S E S G P R G V H F I<br>1441 ACCCTGAGTAAACAAAGCATCTCCAACTCTGAGTCTGGCCCTCGGGGAGTGCATTTCATT<br>501 F N K E N F -<br>1501 TTCAACAAGGAAAACTTCTAA | |
| B1961434.V1.3_AT/<br>B1961054.V1.3_AT<br>B1961434.V1.3_S_AT | IP-10 mRNA for interferon-gamma-inducible protein-10 | 61 AGCACCATGAACACAAGTGGTTTTCTTATTTTCTGCCTTATCCTTCTGACTCTGAGTCAA<br>121 GGCATACCTCTCTCTAGGAATACACGCTGTACCTGCATCGAGATCAGTAATGGATCTGTT<br>181 AATCCAAGGTCCTTAGAAAAACTTGAACTGATTCCTGCAAGTCAATCCTGCCCACGTGTT<br>241 GAGATCATTGCCACAATGAAAAAGAATGGGGAGAAAAGATGTCTGAATCCAGAGTCCAAG<br>301 ACCGTCAAGAATTTACTGAAAGCAATTAGCAAGCAAAGGTCTAAAAGATCTCCTCGAACA<br>361 CTGAGAGAAGTATAATTACGGTACTACTGATAGGATGGCCCAGAGAGAGGCCGCCTCTGC<br>421 CATCATTTCCCTGCATACAGTATATGTCAAGCCCTAATTGTCCCCGGATTGCAGTTCTCC<br>481 TAAAAGATGACCAAGCCAGTCACCTAATTAGCTGCTACTACTCCTGCAGGGGGTGGATGG<br>541 TTCATCATCCTGAGCTGTTCAGTAGTAACTCTGCCTTGGCACTATGACTATAAACTATGC<br>601 TGAGGTGCTACATTCTTAGTAAATGTGCCAAGACCTAGTCCTACTACTGACACTTTCCTC<br>661 GCCTTGCCATACTCTAAAGGTTCTCAACGGATCTTTCCACCTCTGGGCTTATCAGAGTTC<br>721 TCAGGATCTCAAATAACTAAAAGGTAATCAAAGCAATAATACAATCTGCTTTTTTAAGAA<br>781 AGATCTTCACTCCATGGACTTCACTGCCATCCCCCAAGGAGCCCATATTCTTCCAGGTT<br>841 ATATACACAAAATTCCAAATACATAGAAGAAGCTAGAAATGTCTGGAAATGTACGTGAAA<br>901 ACAGTATTATTTAATGGAAAGCTATACAAAATAGAAGTCTTAGATGTACATATTTCTTAC<br>961 ATTGTTTTCAGTGTTTATGGAATACTTACGTGATTAAGTACTACACATGAATGACCAAT<br>1021 AGGAGAAAATTTTGAAATCTAGATATATGTTCTGCATGATATGTAAGACAAAATATGCT<br>1081 GGATGTTTTTCAAATAGAAAATAATGTGCTCTCCCAGAAATATTAAGA | SEQ ID NO: 17 |
| | | 1 M N T S G F L I F C L I L L T L S Q G I<br>1 ATGAACACAAGTGGTTTTCTTATTTTCTGCCTTATCCTTCTGACTCTGAGTCAAGGCATA<br>21 P L S R N T R C T C I E I S N G S V N P<br>61 CCTCTCTCTAGGAATACACGCTGTACCTGCATCGAGATCAGTAATGGATCTGTTAATCCA<br>41 R S L E K L E L I P A S Q S C P R V E I<br>121 AGGTCCTTAGAAAAACTTGAACTGATTCCTGCAAGTCAATCCTGCCCACGTGTTGAGATC<br>61 I A T M K K N G E K R C L N P E S K T V<br>181 ATTGCCACAATGAAAAAGAATGGGGAGAAAAGATGTCTGAATCCAGAGTCCAAGACCGTC<br>81 K N L L K A I S K Q R S K R S P R T L R<br>241 AAGAATTTACTGAAAGCAATTAGCAAGCAAAGGTCTAAAAGATCTCCTCGAACACTGAGA<br>101 E V -<br>301 GAAGTATAA | SEQ ID NO: 18 |
| BM780886.V1.3_AT | Homo sapiens 6-phosphogluconolactonase mnRNA (cDNA clone MGC: 20013 IMAGE: 4053022). | 1 CTCCTCCCCGCCGCCGCCCTCGCCATGGCCGCGCCGGCCCCGGGCCTCATCTCGGTGTTC<br>61 TCGAGTTCCCAGGAGCTGGGTGCGGCGCTAGCGCAGCTGGTGGCCCAGCGCGCAGCATGC<br>121 TGCCTGGCAGGGGCCCGCGCCCGTTTCGCGCTCGGCTTGTCGGCGGGAGCCTCGTCTCG<br>181 ATGCTAGCCCGCGAGCTACCCGCCGCCGTCGCCCCTGCCGGGCCAGCTAGCTTAGCGCGC<br>241 TGGACGCTGGGCTTCTGCGACGAGCGCCTCGTGCCCTTCGATACGCCGAGAGCACGTAC<br>301 GGCCTCTACCGGACGCATCTTCTCTCCAGACTGCCGATCCCAGAAAGCCAGGTGATCACC<br>361 ATTAACCCCGAGCTGCCTGTGGAGGACGCGGCTGAGGACTACGCCAAGAAGCTGAGACAG<br>421 GCATTCAAGGGGACTCCATCCCGGTTTTCGACCTGCTGATCCTGGGGGTGGGCCCCGAT<br>481 GGTCACACCTGCTCACTCTTCCCAGACCACCCCCTCCTACAGGAGCGGGAGAAGATTGTG<br>541 GCTCCCATCAGTGACTCCCCGAAGCCACCGCCACAGCGTGTGACCCTCACGCTACCTGTC<br>601 CTGAATGCAGCACGAACTGTCATCTTTGTGGCAACTGGAGAAGGCAAGGCAGCTGTTCTG<br>661 AAGCGCATTTTGGAGGACAAGGAGGAAAACCCGCTCCCCGCCGCCCTGGTCCAGCCCCAC<br>721 ACTGGGAAACTCTGCTGGTTCCTGGACGAGGCAGCGGCCCGACTCCTGACCGTGCCCTTC<br>781 GAGAAGCATTCCACTTTGTAGCTGGCCAGAGGGACGCCGCAGCTGGGACCAGGCACGCAG<br>841 CCCATGGGCTGGGCCCTGCTGGCCGCCACTCTCCGGGCTCTCCTTTCAAAAAGCCACG<br>901 TCGTGCTGCTGCTGGAAGCCAACAGCCTCCGGCCAGCAGCCCTACCCGGGGCTCAACACA<br>961 CAGGCTGTGGCTCTGGACATCCGGATATTAAAAGGAGCGTTGCTGGAAAAAAAAAAAAAA<br>1021 AAAAAAAAAAAAA | SEQ ID NO: 19 |
| | | 1 M A A P A P G L I S V F S S S Q E L G A<br>1 ATGGCCGCGCCGGCCCCGGGCCTCATCTCGGTGTTCTCGAGTTCCCAGGAGCTGGGTGCG<br>21 A L A Q L V A Q R A A C C L A G A R A R<br>61 CCGCTAGCGCAGCTGGTGGCCCAGCGCGCAGCATGCTGCCTGGCAGGGGCCCGCGCCCGT | SEQ ID NO: 20 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 41  F   A   L   G   L   S   G   G   S   L   V   S   M   L   A   R   E   L   P   A<br>121 TTCGCGCTCGGCTTGTCGGGCGGGAGCCTCGTCTCGATGCTAGCCCCGCGAGCTACCCGCC<br>61  A   V   A   P   A   G   P   A   S   L   A   R   W   T   L   G   F   C   D   E<br>181 GCCGTCGCCCCTGCCGGGCCAGCTAGCTTAGCGCGCTGGACGCTGGGCTTCTGCGACGAG<br>81  R   L   V   P   F   D   H   A   E   S   T   Y   G   L   Y   R   T   H   L   L<br>241 CGCCTCGTGCCCTTCGATCACGCCGAGAGCACGTACGGCCTCTACCGGACGCATCTTCTC<br>101 S   R   L   P   I   P   E   S   Q   V   I   T   I   N   P   E   L   P   V   E<br>301 TCCAGACTGCCGATCCCAGAAAGCCAGGTGATCACCATTAACCCCGAGCTGCCTGTGGAG<br>121 E   A   A   E   D   Y   A   K   K   L   R   Q   A   F   Q   G   D   S   I   P<br>361 GAGGCGGCTGAGGACTACGCCAAGAAGCTGAGACAGGCATTCCAAGGGGACTCCATCCCG<br>141 V   F   D   L   L   I   L   G   V   G   P   D   G   H   T   C   S   L   F   P<br>421 GTTTTCGACCTGCTGATCCTGGGGGTGGGCCCCGATGGTCACACCTGCTCACTCTTCCCA<br>161 D   H   P   L   L   Q   E   R   E   K   I   V   A   P   I   S   D   S   P   K<br>481 GACCACCCCCTCCTACAGGAGCGGGAGAAGATTGTAACTCCCATCAGTGACTCCCCGAAG<br>181 P   P   P   Q   R   V   T   L   T   L   P   V   L   N   A   A   R   T   V   I<br>541 CCACCGCCACAGCGTGTGACCCTCACGCTACCTGTCCTGAATGCAGCACGAACTGTCATC<br>201 F   V   A   T   G   E   G   K   A   A   V   L   K   R   I   L   E   D   K   E<br>601 TTTGTGGCAACTGGAGAAGGCAAGGCAGCTGTTCTGAAGCGCATTTTGGAGGACAAGGAG<br>221 E   N   P   L   P   A   A   L   V   Q   P   H   T   G   K   L   C   W   F   L<br>661 GAAAACCCGCTCCCCGCCGCCCTGGTCCAGCCCCACACTGGGAAACTCTGCTGGTTCCTG<br>241 D   E   A   A   A   R   L   L   T   V   P   F   E   K   H   S   T   L   -<br>721 GACGAGGCAGCGGCCCGACTCCTGACCGTGCCCTTCGAGAAGCATTCCACTTTGTAG | |
| WBC004E01_V1.3_AT | Homo sapiens Apo-2 ligand mRNA, complete cds | 1 TTTCCTCACTGACTATAAAGAATAGAGAAGGAAGGGCTTCAGTGACCGGCTGCCTGGCT<br>61 GACTTACAGCAGTCAGACTCTGACAGGATCATGGCTATGATGGAGGTCCAGGGGGGACCC<br>121 AGCCTGGGACAGACCTGCGTGCTGATCGTGATCAACACAGTGCTCCTGCAGTCTCTCTGT<br>181 GTGGCTGTAACTTACGTGTACTTTACCAACGAGCTGAAGCAGATGCAGATCAAATACTCC<br>241 AAAAGTGGCATTGCCTGTTTCTTAAAGGAAGATGACAGCGATTGGGACCCAATGACGAA<br>301 GAGAGTATGAACAGCCCTGCTGGCAAGTCAAGTGGCAGCTGCGTCAGTTTGTTAGAAAG<br>361 ATGATTTTGAGAACCTATGAGGAATCCATTCCTACAACTTCAGAAAAGCGACAAAATATT<br>421 CCTCCCTTAGTAACAGAAAGAGGTCTTCAGAGAGTAGCAGCTCACATAACTGGGACCAGT<br>481 CGGAGAAGAAGCACAGTCTCAATTCCACGCTCCAAGAATGAAAAAGCACTGGGCAGAAA<br>541 ATAAACGCCTGGGAGACATCAAGAAAGGACATTCGTTCTTGAATAATTTACACTTGAGG<br>601 AATGGAGAGCTGGTTATCCATCAAACAGGGTTTTATTACATCTATTCCCAAACATACTTT<br>661 CGATTTCAGGAGGAAATAAAAGAAAACACAAAGAACGACAAACAAATGGTACAATATATT<br>721 TACAAAAGCACAGACTATCCTGACCCTATACTGCTGATGAAAAGTGCTAGAAATAGTTGT<br>781 TGGTCTAAAGATTCAGAATATGGACTCTATTCCATCTATCAAGGTGGAATATTTGAGCTT<br>841 AAGGAAATGACAGAATTTTTGTCTCTGTAACAAAATGAGCAATTGATTGACATGGACCAA<br>901 GAAGCCAGTTTCTTCGGGGCCTTTTTAGTTGGCTAACTGACCTGGAAAGAAAAGCAATA<br>961 ACCTCAAAGTGACTATTCAGTTTTCAGGATGACACTATGAAGATGTTTCAAAAAATCT<br>1021 GACCAAAACAAACAAACAGAAA | SEQ ID NO: 21 |
| | | 1   M   A   M   M   E   V   Q   G   G   P   S   L   G   Q   T   C   V   L   I   V<br>1 ATGGCTATGATGGAGGTCCAGGGGGGACCCAGCCTGGGACAGACCTGCGTGCTGATCGTG<br>21  I   F   T   V   L   L   Q   S   L   C   V   A   V   T   Y   V   Y   F   T   N<br>61 ATCTTCACAGTGCTCCTGCAGTCTCTCTGTGTGGCTGTAACTTACGTGTACTTTACCAAC<br>41  E   L   K   Q   M   Q   I   K   Y   S   K   S   G   I   A   C   F   L   K   E<br>121 GAGCTGAAGCAGATGCAGATCAAATACTCCAAAAGTGGCATTGCCTGTTTCTTAAAGGAA<br>61  D   D   S   D   W   D   P   N   D   E   E   S   M   N   S   P   C   W   Q   V<br>181 GATGACAGCGATTGGGACCCAAATGACGAAGAGAGTATGAACAGCCCTGCTGGCAAGTC<br>81  K   W   Q   L   R   Q   F   V   R   K   M   I   L   R   T   Y   E   E   S   I<br>241 AAGTGGCAGCTGCGTCAGTTTGTTAGAAAGATGATTTTGAGAACCTATGAGGAATCCATT<br>101 P   T   T   S   E   K   R   Q   N   I   P   P   L   V   R   S   R   G   L   Q<br>301 CCTACAACTTCAGAAAAGCGACAAAATATTCCTCCCTTAGTAAGAGAAAGAGGTCTTCAG<br>121 R   V   A   A   H   I   T   G   T   S   R   R   R   S   T   V   S   I   P   R<br>361 AGAGTAGCAGCTCACATAACTGGGACCAGTCGGAGAAGAAGCACAGTCTCAATTCCACGC<br>141 S   K   N   E   K   A   L   G   R   K   I   N   A   W   E   T   S   R   K   G<br>421 TCCAAGAATGAAAAAGCACTGGGCAGAAAATAAACGCCTGGGAGACATCAAGAAAGGA<br>161 H   S   F   L   N   N   L   H   L   R   N   G   E   L   V   I   H   Q   T   G<br>481 CATTCGTTCTTGAATAATTTACACTTGAGGAATGGAGAGCTGGTTATCCATCAAACAGGG<br>181 F   Y   Y   I   Y   S   Q   T   Y   F   R   F   Q   E   E   I   K   E   N   T<br>541 TTTTATTACATCTATTCCCAAACATACTTTCGATTTCAGGAGGAAATAAAAGAAAACACA<br>201 K   N   D   K   Q   M   V   Q   Y   I   Y   K   S   T   D   Y   P   D   P   I<br>601 AAGAACGACAAACAAATGGTACAATATATTTACAAAAGCACAGACTATCCTGACCCTATA<br>221 L   L   M   K   S   A   R   N   S   C   W   S   K   D   S   E   Y   G   L   Y<br>661 CTGCTGATGAAAAGTGCTAGAAATAGTTGTTGGTCTAAAGATTCAGAATATGGACTCTAT<br>241 S   I   Y   Q   G   G   I   F   E   L   K   E   N   D   R   I   F   V   S   V<br>721 TCCATCTATCAAGGTGGAATATTTGAGCTTAAGGAAATGACAGAATTTTTGTCTCTGTA<br>261 T   N   E   Q   L   I   D   M   D   Q   E   A   S   F   F   G   A   F   L   V<br>781 ACTAATGAGCAATTGATTGACATGGACCAAGAAGCCAGTTTCTTCGGGGCCTTTTTAGTT<br>281 G   -<br>841 GGCTAA | SEQ ID NO: 22 |

TABLE 1-continued

| Gene | GenBank Homology | DNA SEQUENCE/DEDUCED AMINO ACID SEQUENCE | SEQUENCE IDENTIFIER: |
|---|---|---|---|
| B1961659.V1.3_AT | No Homology | 1 GCACGAGGACCATCCATATCAAATATGCCCATTCAAACATTACCCAGCATCATGGCTTAT<br>61 GATCAGGACTCCGGTCCTTATGTCTAGTAGCATTTTGAATCCTTTATGCCATGATAGTG<br>121 CCGCAGTATCGAGAGGATTTTATGGAGAATTGGAATAGTCTCCATGACCACAGCTAAATA<br>181 AAGGACAAGCAGCCTGTCTTGGGGTTTTGAAAAGGTTATTCTTAACAATCTTTTTTTTT<br>241 CCTACCCAGGGACTTTCTGACAGTATGACTGTTACCTTACTTGAAAAGCAGTACCCAATT<br>301 GCTTTATTATTTTAAATAGATTCACATTAACCAACATAATTTTTTAGATTGTTTAGGATT<br>361 AGCCTGAGTTTCTAAGTCAGCTTCCAGCTGTGTTTCATCTCCTTCACCTGCATTTTATTT<br>421 GGTGTTTGTCTGAAGGAAAGAGGAAAGCAAATGTGAATTGTACTATTTGTACTAATCTTT<br>481 GGAATTTATTGGTAAATTTATTTCAGGATAGGGTATCAGAAAAAGAAAACTTTGTTTCT<br>541 TAGACTGAAGGTCTAACTGATTAATAATTTGACTTATAAGCATGGTTTGTTCACTCCTTC<br>601 AAATGAATTTACTTTGAAAACAAATGAAGAGCTGCTCTCCTTCTTTCCTCCACTAAGCAG<br>661 ATGATCCTGCTGGATTCCCGCTGGAGCAGTGCTACCCTCTGTTCCGGTGATTGGTTTGTT<br>721 CCTTTCTTGTATCCCCAAAGTGGACACAAACAACTACACGATCCCAGAGACATATCTAG<br>781 TTAATTCCAGCTGACGAGAGACCAGAAAATTGTAAATGGATGGTTTGATATTACTGCA | SEQ ID NO: 23 |
| WBC008B04 | No homology | 1 GACAATAGCAGTTATTAAATTGGGTCTCTCATCTGTATGTTTTGTTACACTGAGGTTAA<br>61 GAGGCCGGATTCTTGGCAGCCAGGTCCCTCTTCAGGATCACGTTGGCTGCAACGTGAGTT<br>121 ATATTGGAGCACTTTAATCTGAAGGATGATACTGTAACTTGATTTATCTAATTAGCTTTT<br>181 AATTATCTATAGCGATTTTATTTAATCCTCCTACAGTCCTGGGGACCTCTGTAAACTT<br>241 CTCAGATGACTCGTATTTTTGTAGTGCTACGAAATTTATTTACAGACCTATAAAGAAAGC<br>301 TGTTTATTCACTTGAAGTCTGAAAATGTACACAGATATGTTATTCTGCAATCTGTTTTG<br>361 TACTTGATAGAAATATATTTTGACTGTGATAACCCAAGTGCCCTGGGGCAGGGGTACTCG<br>421 GCATGGTTCCTCCTCTGAAGAGCGGGTGTGGAAACCTCAACTGCTCACGAGAAGTGCTTG<br>481 GTTTGGGGACAGCTGCTGCTAGGACGTGGGCGATGTGACTTGGTCAGGGTGTGAGAGGGG<br>541 CGTCTGGCTGGAGGAGAGTTCCTGTGCTCTGAAATGCCACTTGGGAACTCTGGAGATTGA<br>601 AGGACAATTTACTTCAAGGGTGTCTGGTTTCTACCACTGCTGGAAAAAAATTCGGTTTGT<br>661 AGCATTCCTGCACCTCACAAGTAGATCGCCTGGAGGTCATTAGTTAATAGCTGTCTGTGA<br>721 GGACTCTGCTTTCAGGGAGAATTTATCT<br><br>Non contiguous<br>1 AAAATGTCAGTCCTTTGCCTGGTTGTTCCATCTCATCTCATTCCTTGGACTTTGACAGAT<br>61 ATCCTGCCCTGTGTTTTATFCCTGFGTGTTAACCTCATCAGGGAAGCAGAATGGGAGGAGC<br>121 AAGAAAGTCTGCCCTTTGCCATGCCAAACAGCTCTCAGCCCTGTGTGGTGAGGCGTGTGC<br>181 GCACGTACATGCATGAGTGGGGTGCATGGGTGTGGTTTCAGCTTTGCTGACAGTGGGAG<br>241 CTCAGCAGAGCGTAGAGGCAGGAAGGTCCATGGCACTCAGCCACACACTATTGAAGGCTA<br>301 GAGGCGGTTTAGTGTTAGATTATGCGGGATCTTTCCCTCCCTGGGTCACTTCTCCCAATCA<br>361 ACCTTTTTTCTTTTTTAGAACTACTAATTAATGATTCCTCAAGGCCGAAAGGTTAATTT<br>421 CCTTGGGAGGAGAACTTAGCCTCCTAGTATCCACACCAGTCTCAACTCTGGTTTCTCAAG<br>481 ATCTGTCACGTTGGCCTACTAACTTGACGTCTTCCCCCCTCCCACTGAAGGATCGCCCAG<br>541 CGTTTTTAGATTGTAGAATTATCTCTTGCTTTGTTACTTTGGGAATTTTGAATTTCTTTG<br>601 GTTTTGTTTTTAAGAAGTAACCTAAAATTTCCTACAACACTAAATAAAATGGTACTACCT<br>661 TTCAAAAAAAAAAAAAAAAAA | SEQ ID NO: 24<br><br><br><br><br><br><br><br><br><br><br><br><br><br><br><br>SEQ ID NO: 25 |
| BM735449.V1.3_AT | No Homology | 1 AATNTCAGTTACTTCAGAAAGTTTTAATTTAGAGTAATTCCAATTCATGCATATAAGCAT<br>61 GAATTGAAAAGATAACTATGATTGTTCTTATATAAAAATATGATTGCCATAGAAGTTAAT<br>121 GAATACACTTATAAGAATGTAATATGATTTCCCTTTACTTCCTACCCTTCTGTTAAACTG<br>181 CTGCTACTGGAGTTCGCCTTTAAAAAATACTTGTTCTTAGCTTTACAGAAGTTGAGATTT<br>241 GAAGTCCTTGGCATCCTGAAGTATGTTATATGCCATGTGCTTGTTATGAAGATTATGGTA<br>301 TGCCAGGAGACATTCTCCTGATTTTCATTATATAGAGAATCATATTTGAGAATGCTGTTC<br>361 TTCTTATCTTTTATAACATCAATTTCCGTTGTTTCGCTTGTCTTTTTTAAATGTCGTCG<br>421 GTTTAAAGAGTTTACTTCATTAAACACTTTACTTCAGCAGTTTGAATAGTAGATGGAAAA<br>481 ATAGGCCCCGGTCTACATTAATTTTCCCCAGTCTGCATTAGAATATTTTTGAAGATTATA<br>541 CTTTTCCAAACAAAGAAAATAATTTGTATTTTGTGTCTAAAATTAAACTTTGTTTAAAAC<br>601 TCTG | SEQ ID NO: 26 |
| WBC029A01 | Homo sapiens programmed cell death 10 (PDCD10), transcript variant 3 | 1 TGCAAGGTGGGAAGTGAAGTCAGTGCCTCAGTTGCTGATCAGTGTGTTTTTGTGTCCAA<br>61 TTCTTTTATCACCAAAAAGAGAAGAAATATTGCAGTGAATGAAGATTCCTCTGCATTTT<br>121 AGCACTGCTTTTTCAACTGTAGTTGGCTTTTGAATGAGGATGACAATGGAAGAGATGAAG<br>181 AATGAAGCTGAGACCACATCCATGGTTTCTATGCCCCTCTATGCAGTCATGTATCCTGTG<br>241 TTTAATGAGCTAGAACGAGTAAATCTGTCTGCAGCCCAGACACTGAGAGCCGCTTTCATC<br>301 AAGGCTGAAAAAGAAATCCAGGTCTCACACAAGACATCATTATGAAAATTTTAGAGAAA<br>361 AAAAGCGTGGAAGTTAACTTCACGGAGTCCCTTCTTCGTATGGCAGCTGATGATGTAGAA<br>421 GAGTATATGATTGAACGACCAGAGCCAGAATTCCAAGACCTAAACGAAAAGGCACGAGCA<br>481 CTTAAACAAATTCTCAGTAAGATCCCAGATGAGATCAATGACAGAGTGAGGTTTCTGCAG<br>541 ACAATCAAGGATATAGCTAGTGCAATAAAAGAACTTCTTGATACAGTGAATAATGTCTTC<br>601 AAGAAATATCAATACCAGAACCGCAGGGCACTTGAACACCAAAAGAAAGAATTTGTAAAG<br>661 TACTCCAAAAGTTTCAGTGATACTCTGAAAACTATTTTTAAAGATGGCAAGGCAATAAAT<br>721 GTGTTCGTAAGTGCCAACCGACTAATTCATCAAACCAACTTAATACTTCAGACCTTCAAA<br>781 ACTGTGGCCTGAAAGTTGTATATGTTAAGAGATGTACTTCTCAGTGGCAGTATTGAACTG<br>841 CCTTTATCTGTAAATTTAAAGTTTGACTGTATAAATTATCAGTCCCTCCTGAAGGGATC<br>901 TAATCCAGGATGTTGAATGGGATTATTGCCATCTTACACCATATTTTTGTAAATGTAGC<br>961 TTAATCATAATCTCACACTGAAGATTTTGCATCACTTTTGCTATTATCATTCTTTTAAGA | SEQ ID NO: 27 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 1021 ATTATAAGCCAAAAGAATTTACGCCTTAATGTGTCATTATATAACATTCCTTAAAAGAAT<br>1081 TGTAAATATTGGTGTTTGTTTCTGACATTTTAACTTGAAAGCGTATATGCTGCAAGATAAT<br>1141 GTATTTAACAATATTTGGTGGCAAATATTCAATAAATAGTTTACATCTGTTAAAAAAAAA<br>1201 AAAAAAAAAAA | |
| | |    1 M R M T M E E M K N E A E T T S M V S M  SEQ ID<br>   1 ATGAGGATGACAATGGAAGAGATGAAGAATGAAGCTGAGACCACATCCATGGTTTCTATG  NO: 28<br>  21 P L Y A V M Y P V F N E L E R V N L S A<br>  61 CCCCTCTATGCAGTCATGTATCCTGTGTTTAATGAGCTAGAACGAGTAAATCTGTCTGCA<br>  41 A Q T L R A A F I K A E K E N P G L T Q<br>121 GCCCAGACACTGAGAGCCGCTTTCATCAAGGCTGAAAAGGAAAATCCAGGTCTCACACAA<br>  61 D I I M K I L E K K S V E V N F T E S L<br>181 GACATCATTATGAAATTTTAGAGAAAAAAAGCGTGGAAGTTAACTTCACGGAGTCCCTT<br>  81 L R M A A D D V E E Y M I E R P E P E F<br>241 CTTCGTATGGCAGCTGATGATGTAGAAGAGTATATGATTGAACGACCAGAGCCAGAATTC<br>101 Q D L N E K A R A L K Q I L S K I P D E<br>301 CAAGACCTAAACGAAAAGGCACGAGCACTTAAACAAATTCTCAGTAAGATCCCAGATGAG<br>121 I N D R V R F L Q T I K D I A S A I K E<br>361 ATCAATGACAGAGTGAGGTTTCTGCAGACAATCAAGGATATAGCTAGTGCAATAAAAGAA<br>141 L L D T V N N V F K K Y Q Y Q N R R A L<br>421 CTTCTTGATACAGTGAATAATGTCTTCAAGAAATATCAATACCAGAACCGCAGGGCACTT<br>161 E H Q E K E F V K Y S K S F S D T L K T<br>481 GAACACCAAAAGAAAGAATTTGTAAAGTACTCCAAAAGTTTCAGTGATACTCTGAAAACG<br>181 V F K D G K A I N V F V S A N R L I H Q<br>541 TATTTTAAAGATGGCAAGGCAATAAATGTGTTCGTAAGTGCCAACCGACTAATTCATCAA<br>201 T N L I L Q T F K T V A -<br>601 ACCAACTTAATACTTCAGACCTTCAAAACTGTGGCCTGA | |
| BM781436.V1.3_AT | *Homo sapiens* SH3 domain binding glutamic acid-rich protein like 3, mRNA |    1 GGGAAGGGGCCTCTGGCGTGCGGGCGGTGTCGCGCAGGTCCCACCCCGCCTGCCCGCGC  SEQ ID<br>  61 CGCCCATTGGTCCCGAGCGCGATGACTTGGCGGGCGGAGCAGGAAGGAAACCGCTCCCGA  NO: 29<br>121 GCACGGCGGCGGCGTCGTCTCCCGGCCAGTGCAGCTGCCGCTACCGCCGCCCTCTGCCCG<br>181 CGGCCCGTCTGTCTACCCCCAGCATGAGCGGCCTGCGCGTCTACAGCACGTCGGTCACCG<br>241 GCTCCCGCGAAATCAAGTCCCAGCAGAGCGAGGTGACCCGAATCCTGGATGGGAAGCGCA<br>301 TCCAGTACCAGCTAGTGGACATCTCTCAGGACAACGCCCTGCGGGATGAGATGCGAGCCT<br>361 TGGCAGGCAACCCTAAGGCCACCCCACCCCAGATTGTCAACGGGGACCAGTACTGTGGGG<br>421 ACTATGAGCTCTTCGTGGAGGCTGTGGAGCAAAACGCTGCAGGAGTTCCTGAAACTGG<br>481 CTTGAGTCAAGCCTGTCCAGAGTTCCCCTGCTGGACTCCATCACCACATTCCCCCCAGCC<br>541 TTCACCTGGCCATGAAGGACCTTTTGACCAACTCCCTGTCATTCCTAACCTAACCTTAGA<br>601 GTCCCTCCCCCAATGCAGGCCACTTCTCCTCCCTCCTCTAAATGTAGTCCCCTCTCCT<br>661 CCATCTAAAGGCCACATTCCTTACCCACTAGTCTCAGAAATTGTCTTAAGCAACAGCCCA<br>721 AGTGCTGGCTGTCCTCAGCCAGGCCCTGGGGCTGCCACCCTGCCTGACACTGGCTGATGG<br>781 GCACCTATGTTGGTTCCATTAGCCAGGGCTCTGCCAAAGGCCCCGCAATCCCTCTCCCAG<br>841 GAGGACCCTAGAGGCAATTAAATGATGTCCTGTTCCATTGGCAAAAAAAAAAAAAAAAAA | |
| | |    1 M S G L R V Y S T S V T G S R E I K S Q  SEQ ID<br>   1 ATGAGCGGCCTGCGCGTCTACAGCACGTCGGTCACCGGCTCCCGCGAAATCAAGTCCCAG  NO: 30<br>  21 Q S E V T R I L D G K R I Q Y Q L V D I<br>  61 CAGAGCGAGGTGACCCGAATCCTGGATGGGAAGCGCATCCAGTACCAGCTAGTGGACATC<br>  41 S Q D N A L R D E M R A L A G N P K A T<br>121 TCTCAGGACAACGCCCTGCGGGATGAGATGCGAGCCTTGGCAGGCAACCCTAAGGCCACC<br>  61 P P Q I V N G D Q Y C G D Y E L F V E A<br>181 CCACCCCAGATTGTCAACGGGGACCAGTACTGTGGGGACTATGAGCTCTTCGTGGAGGCT<br>  81 V E Q N T L Q E F L K L A -<br>241 GTGGAGCAAAACACGCTGCAGGAGTTCCTGAAACTGGCTTGA | |
| BM735054.V1.3_AT | *Homo sapiens* family with sequence similarity 14, member A, mRNA (cDNA clone MGC: 44913 IMAGE: 5229498). |    1 CCGGACGGCCTCACCATCATGAAACGGGCAGCTGCTGCTGCAGTGGGAGGAGCCCTGACC  SEQ ID<br>  61 GTGGGGGCTGTCCCCGTGGTGCTCGGCGCCATGGGCTTCACTGGGGCAGGAATCACCGCC  NO: 31<br>121 TCGTCCTTAGCGGCCAAGATGATGTCCACGGCCGCCATTGCCAACGGGGGTGGAGTTGCG<br>181 GCCGGCAGCCTGGTGGCCACTCTACAGTCCGTGGGAGCGGCTGGACTCTCCACATCATCC<br>241 AACATCCTCCTGGCCTCTGTTGGGTCAGTGTTGGGGGCCTGCTTGGGGAATTCACCTTCT<br>301 TCTTTCTCTCCCAGCTGAACCCGAGGCTAAAGAAGATGAGGCAAGAGAAAATGTACCCCAA<br>361 GGTGAACCTCCAAAACCCCCACTCAAGTCAGAGAAACATGAGGAATAAAGGTCACATGCA<br>421 GATGCAAAAAAAAAAAAAAAAAAAAAAAAAAAAAAAAAAAAAAAAAAAAAAAAAAAAAA<br>481 AAAAAAAAAAAAA | |
| | |    1 M M K R A A A A A V G G A L T V G A V P  SEQ ID<br>   1 ATGATGAAACGGGCAGCTGCTGCTGCAGTGGGAGGAGCCCTGACCGTGGGGGCTGTCCCC  NO: 32<br>  21 V V L G A M G F T G A G I T A S S L A A<br>  61 GTGGTGCTCGGCGCCATGGGCTTCACTGGGGCAGGAATCACCGCCTCGTCCTTAGCGGCC<br>  41 K M M S T A A I A N G G G V A A G S L V<br>121 AAGATGATGTCCACGGCCGCCATTGCCAACGGGGGTGGAGTTGCGGCCGGCAGCCTGGTG<br>  61 A T L Q S V G A A G L S T S S N I L L A<br>181 GCCACTCTACAGTCCGTGGGAGCGGCTGGACTCTCCACATCATCCAACATCCTCCTGGCC | |

TABLE 1-continued

| Gene | GenBank Homology | DNA SEQUENCE/DEDUCED AMINO ACID SEQUENCE | SEQUENCE IDENTIFIER: |
|---|---|---|---|
| | | 81  S  V  G  S  V  L  G  A  C  L  G  N  S  P  S  S  S  L  P  A<br>241 TCTGTTGGGTCAGTGTTGGGGCCTGCTTGGGGAATTCACCTTCTTCTTCTCTCCCAGCT<br>101  E  P  E  A  K  E  D  E  A  R  E  N  V  P  Q  G  E  P  P  K<br>301 GAACCCGAGGCTAAAGAAGATGAGGCAAGAGAAAATGTACCCCAAGGTGAACCTCCAAAA<br>121  P  P  L  K  S  E  K  H  E  E  -<br>361 CCCCCACTCAAGTCAGAGAAACATGAGGAATAA | |
| WBC31 | No homology | 1 GGCTTTTGAAGAGGTTTGGAGACAAGTTTTGTTTGTCGCGAGGACTTGGGGCTCCTACTG<br>61 GCGTGTAGCGGGCAGGGACTAGGGGTTCTAAACAGCCTGCCATGCGTCTGTGCAATGAAG<br>121 AGTTGGCCCACCCCCTGGATCCCCCTTGAGAGACTCTGGCAGCTGATGTGGCTCCTTGTG<br>181 GAAACAAGAGGAACAGGGAATAAGGATTCCCACCTCTCCTGTCAGGAAAGCGTTGACACT<br>241 GACCTACTCTGGGAATGGACGGGGAAGAAATCTGGGAGCTGGGAGTCACTGCTGAAACTG<br>301 GCAAACAATTACTAGGCATTAAGTCTGCGGAGGGCCATTTGCTGTGCAGAACCAAGGAAC<br>361 ACAAACAATAAGAAGACCGTCCGTACCCGTCCTGAAGGAGTTCACGGTCAGGCTGGGAGA<br>421 AATAATAGCAATAATAATAACGCATTAAGTTTCTGCTGAATACCGGATGTGTTTACATCC<br>481 ATCTTTTCACTTGATGCAGTCCTGAATCTGGTTCTATGATCAGCCCCCAGGTACAGAGGA<br>541 GGACACTGAGGCTCAGCGGTTACATGACATACGTCATGTAACCCCTCATGTATGTGATGT<br>601 AACACAGAAGTATGGGACCGAGCTGGGATTTGAACCCAGGTCTCACACCAAGGCCCGTGA<br>661 TTTTTCTACCAGACCTCACTGCCTCTGCTTAGGGAAGAGATCATATCTGCCCCAGCTG<br>721 GATGTTTCGAGGATCCTCCTCCCTCTAGACATTGGGAGAAAGATTCTTTGGAACCCCCCC<br>781 CAAACACACACACACACCAAGTTGAGTGACCTAAAGAAAAGGGGACAAGGTGGCCAATGC<br>841 AAATGAGAGAGCTCCCTGTCCTCAGCCCTGAACTGGGAATTGCTGAATGGAGCAATAAAA<br>901 TGGAAAAAGGCCAAGTGGCTGCTTGGAAAGGTGG | SEQ ID NO: 33 |
| | | NON CONTIGUOUS<br>1 TCTAGACATTGGGAGAAGATTCTTTGGAAACCCCCCCCACACACACACACACACCAAGTT<br>61 GAGTGACCTAAAGAAAAGGGGACAAGGTGGCCAATGCAGATTGAGAGCTCCCTGTCCTCA<br>121 GCCCTGAACTGGGAATTGCTGAATGGGAGCAATAAGATGGAGAGAGGCCAAGTGGCTGCT<br>181 TGGAGAGGTGGTCACAGGGGTAGGAGAGCTTAGCTCTACACGCTCAAACTTCCCAGGGTCCT<br>241 GGGCTTCCCAAGGGCCACAGTCTCTAGCCAACCAAACTCACAAGAGCCTGATGTATAAGC<br>301 CAGAGGCCCAGTGTTTCCACCAGGCGTGGAGTAAGCAGATAAGAGCTCAGCTCTGGAGCT<br>361 GTTAGTGCCTGGTGTAACTCTTGCCTCCACCAATCACTAGCCCTGTGATTCTGTGCAAGT<br>421 TATTGATTGATCTCTCTAAGCCTCAATTTCCTCATCTGTGAAATGGCAATAAATGTTCA<br>481 ATACAAAAAAAAAAAAAAAA | SEQ ID NO: 34 |
| BM734900 | Homo sapiens matrix metalloproteinase 9 (gelatinase B, 92 kDa gelatinase, 92 kDa type IV collagenase), mRNA (cDNA clone MGC: 12688 IMAGE: 4054882) | 1 TCACCATGAGCCTCTGGCAGCCCCTGGTCCTGGTGCTCCTGGTGCTGGGCTGCTGCTTTG<br>61 CTGCCCCCAGACAGCGCCAGTCCACCCTTGTGCTCTTCCCTGGAGACCTGAGAACCAATC<br>121 TCACCGACAGGCAGCTGGCAGAGGAATACCTGTACCGCTATGGTTACACTCGGGTGGCAG<br>181 AGATGCGTGGAGAGTCGAAATCTCTGGGGCCTGCGCTGCTTCTCCAGAAGCAACTGT<br>241 CCCTGCCCGAGACCGGTGAGCTGGATAGCGCCACGCTGAAGGCCATGCGAACCCCACGGT<br>301 GCGGGGTCCCAGACCTGGGCAGATTCCAAACCTTTGAGGGCGACCTCAAGTGGCACCACC<br>361 ACAACATCACCTATTGGATCCAAAACTACTCGGAAGACTTGCCGCGGGCGGTGATTGACG<br>421 ACGCCTTTGCCCGCGCCTTCGCACTGTGGAGCGCGGTGACGCCGCTCACCTTCACTCGCG<br>481 TGTACAGCCGCGACGCAGACATCGTCATCCAGTTTGGTGTCGCGGAGCACGGAGACGGGT<br>541 ATCCCTTCGACGGGAAGGACGGGCTCCTGGCACACGCCTTTCCTCCTGGCCCGGCATTC<br>601 AGGGAGACGCCCATTTCGACGATGACGAGTTGTGGTCCCTGGGCAAGGGCGTCGTGGTTC<br>661 CAACTCGGTTTGGAAACGCAGATGGCGCGGCCGCCACTTCCCCTTCATCTTCGAGGGCC<br>721 GCTCCTACTCTGCCTGCACCACCGACGGTCGCTCCGACGGCTTGCCCTGGTGCAGTACCA<br>781 CGGCCAACTACGACACCGACGACCGGTTTGGCTTCTGCCCCAGCGAGAGACTCTACACCC<br>841 GGGACGGCAATGCTGATGGGAAACCCTGCCAGTTTCCATTCATCTTCCAAGGCCAATCCT<br>901 ACTCCGCCTGCACCACGGACGGTCGCTCCGACGGCTACCGCTGGTGCGCCACCACCGCCA<br>961 ACTACGACCGGGACAAGCTCTTCGGCTTCTGCCCGACCCGAGCTGACTCGACGGTGATGG<br>1021 GGGGCAACTCGGCGGGGAGCTGTGCGTCTTCCCCTTCACTTTCCTGGGTAAGGAGTACT<br>1081 CGACCTGTACCAGCGAGGGCCGCGGAGATGGGCGCCTCTGGTGCGCTACCACCTCGAACT<br>1141 TTGACAGCGACAAGAAGTGGGGCTTCTGCCCGGACCAAGGATACAGTTTGTTCCTCGTGG<br>1201 CGGCGCATGAGTTCGGCCACGCGCTGGGCTTAGATCATTCCTCAGTGCCGGAGGCGCTCA<br>1261 TGTACCCTATGTACCGCTTCACTGAGGGGCCCCCCTTGCATAAGGACGACGTGAATGGCA<br>1321 TCCGGCACCTCTATGGTCCTCGCCCTGAACCTGAGCCACGGCCTCCAACCACCACCACAC<br>1381 CGCAGCCCACGGCTCCCCCGACGGTCTGCCCCACCGGACCCCCCACTGTCCACCCCTCAG<br>1441 AGCGCCCCACAGCTGGCCCCACAGGTCCCCCAGCTGGCCCACAGGTCCCCCCACTG<br>1501 CTGGCCCTTCTACGGCCACTACTGTGCCCTTTGAGTCCGGTGGACGATGCCTGCAACGTGA<br>1561 ACATCTTCGACGCCATCGCGGAGATTGGGAACCAGCTGTATTTGTTCAAGGATGGGAAGT<br>1621 ACTGGCGATTCTCTGAGGGCAGGGGGAGCCGGCCGCAGGGCCCCTTCCTTATCGCCGACA<br>1681 AGTGGCCCGCGCTGCCCCGCAAGCTGGACTCGGTCTTTGAGGAGCCGCTCTCCAAGAAGC<br>1741 TTTTCTTCTTCTCTGGGCGCCAGGTGTGGGTGTACACAGGCGCGTCGGTGCTGGGCCCGA<br>1801 GGCGTCTGGACAAGCTGGGCCTGGGAGCCGACGTGGCCCAGGTGACCGGGGCCCTCCGGA<br>1861 GTGGCAGGGGAAGATGCTGCTGTTCAGCGGGCGGCGCCTCTGGAGGTTCGACGTGAAGG<br>1921 CGCAGATGGTGGATCCCGGAGCGCCAGCGAGGTGGACCGGATGTTCCCCGGGGTGCCTT<br>1981 TGGACACGCACGACGTCTTCCAGTACCGAGAGAAAGCCTATTTCTGCCAGGACCGCTTCT<br>2041 ACTGGCGCGTGAGTTCCCGGAGTGAGTTGAACCAGGTGGACCAAGTGGGCTACGTGACCT<br>2101 ATGACATCCTGCAGTGCCCTGAGGACTAGGGCTCCCGTCCTGCTTTGGCAGTGCCATGTA | SEQ ID NO: 35 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 2161 AATCCCCACTGGGACCAACCCTGGGGAAGGAGCCAGTTTGCCGGATACAAACTGGTATTC<br>2221 TGTTCTGGAGGAAAGGGAGGAGTGGAGGTGGGCTGGGCCCTCTCTTCTCACCTTTGTTTT<br>2281 TTGTTGGAGTGTTTCTAATAAACTTGGATTCTCTAACCTTTAAAAAAAAAAAAAAAAAAA<br>2341 AAAAAAAAAAAAAAAAAAAAAAAAAAAAAA<br><br>   1  M  S  L  W  Q  P  L  V  L  V  L  L  V  L  G  C  C  F  A  A<br>   1 ATGAGCCTCTGGCAGCCCCTGGTCCTGGTGCTCCTGGTGCTGGGCTGCTGCTTTGCTGCC<br>  21  P  R  Q  R  Q  S  T  L  V  L  F  P  G  D  L  R  T  N  L  T<br>  61 CCCAGACAGCGCCAGTCCACCCTTGTGCTCTTCCCTGGAGACCTGAGAACCAATCTCACC<br>  41  D  R  Q  L  A  E  E  Y  L  Y  R  Y  G  Y  T  R  V  A  E  M<br> 121 GACAGGCAGCTGGCAGAGGAATACCTGTACCGCTATGGTTACACTCGGGTGGCAGAGATG<br>  61  R  G  E  S  K  S  L  G  P  A  L  L  L  L  Q  K  Q  L  S  L<br> 181 CGTGGAGAGTCGAAATCTCTGGGGCCTGCGCTGCTGCTTCTCCAGAAGCAACTGTCCCTG<br>  81  P  E  T  G  E  L  D  S  A  T  L  K  A  M  R  T  P  R  C  G<br> 241 CCCGAGACCGGTGAGCTGGATAGCGCCACGCTGAAGGCCATGCGAACCCCACGGTGCGGG<br> 101  V  P  D  L  G  R  F  Q  T  F  E  G  D  L  K  W  H  H  H  N<br> 301 GTCCCAGACCTGGGCAGATTCCAAACCTTTGAGGGCGACCTCAAGTGGCACCACCACAAC<br> 121  I  T  Y  W  I  Q  N  Y  S  E  D  L  P  R  A  V  I  D  D  A<br> 361 ATCACCTATTGGATCCAAAACTACTCCGAAGACTTGCCGCGGGCGGTGATTGACGACGCC<br> 141  F  A  R  A  F  A  L  W  S  A  V  T  P  L  T  F  T  R  V  Y<br> 421 TTTGCCCGCGCCTTCGCACTGTGGAGCGCGGTGACGCCGCTCACCTTCACTCGCGTGTAC<br> 161  S  R  D  A  D  I  V  I  Q  F  G  V  A  E  H  G  D  G  Y  P<br> 481 AGCCGGGACGCAGACATCGTCATCCAGTTTGGTGTCGCGGAGCACGGAGACGGGTATCCC<br> 181  F  D  G  K  D  G  L  L  A  H  A  F  P  P  P  G  P  G  I  Q  G<br> 541 TTCGACGGAAGGACGGGCTCCTGGCACACGCCTTTCCTCCTGGCCCCGGCATTCAGGGA<br> 201  D  A  H  F  D  D  D  E  L  W  S  L  G  K  G  V  V  V  P  T<br> 601 GACGCCCATTTCGACGATGACGAGTTGTGGTCCCTGGGCAAGGGCGTCGTGGTTCCAACT<br> 221  R  F  G  N  A  D  G  A  A  C  H  F  P  F  I  F  E  G  R  S<br> 661 CGGTTTGGAAACGCAGATGGCGCGGCCTGCCACTTCCCCTTCATCTTCGAGGGCCGCTCC<br> 241  Y  S  A  C  T  T  D  G  R  S  D  G  L  P  W  C  S  T  T  A<br> 721 TACTCTGCCTGCACCACCGACGGTCGCTCCGACGGCTTGCCCTGGTGCAGTACCACGGCC<br> 261  N  Y  D  T  D  D  R  F  G  F  C  P  S  E  R  L  Y  T  R  D<br> 781 AACTACGACACCGACGACCGGTTTGGCTTCTGCCCCAGCGAGAGACTCTACACCCGGGAC<br> 281  G  N  A  D  G  K  C  Q  F  P  F  I  F  Q  G  Q  S  Y  S<br> 841 GGCAATGCTGATGGGAAACCCTGCCAGTTTCCATTCATCTTCCAAGGCCAATCCTACTCC<br> 301  A  C  T  T  D  G  R  S  D  G  Y  R  W  C  A  T  T  A  N  Y<br> 901 GCCTGCACCACGGACGGTCGCTCCGACGGCTACCGCTGGTGCGCCACCACCGCCAACTAC<br> 321  D  R  D  K  L  F  G  F  C  P  T  R  A  D  S  T  V  M  G  G<br> 961 GACCGGGACAAGCTCTTCGGCTTCTGCCCCGACCGAGCTGACTCGACGGTGATGGGGGGC<br> 341  N  S  A  G  E  L  C  V  F  P  P  T  F  L  G  K  E  Y  S  T<br>1021 AACTCGGCGGGGAGCTGTGCGTCTTCCCCTTCACTTTCCTGGGTAAGGAGTACTCGACC<br> 361  C  T  S  E  G  R  G  D  G  R  L  W  C  A  T  T  S  N  F  D<br>1081 TGTACCAGCGAGGGCCGCGGAGATGGGCGCCTCTGGTGCGCTACCACCTCGAACTTTGAC<br> 381  S  D  K  K  W  G  F  C  P  D  Q  G  Y  S  L  F  L  V  A  A<br>1141 AGCGACAAGAAGTGGGGCTTCTGCCCGGACCAAGGATACAGTTTGTTCCTCGTGGCGGCG<br> 401  H  E  F  G  H  A  L  G  L  D  H  S  S  V  P  E  A  L  M  Y<br>1201 CATGAGTTCGGCCACGCGCTGGGCTTAGATCATTCCTCAGTGCCGGAGGCGCTCATGTAC<br> 421  P  M  Y  R  F  T  E  G  P  P  L  H  K  D  D  V  N  G  I  R<br>1261 CCTATGTACCGCTTCACTGAGGGGCCCCCCFTGCATAAGGACGACGTGAATGGCATCCCG<br> 441  H  L  Y  G  P  R  P  E  P  R  P  P  T  T  T  T  P  Q<br>1321 CACCTCTATGGTCCTCGCCCTGAACCTGAGCCACGGCCTCCAACCACCACCACACCGCAG<br> 461  P  T  A  P  P  T  V  C  P  T  G  P  P  T  V  H  P  S  E  R<br>1381 CCCACGGCTCCCCCGACGGTCTGCCCCACCGGACCCCCCACTGTCCACCCCTCAGAGCGC<br> 481  P  T  A  G  P  T  G  P  P  S  A  G  P  T  G  P  P  T  A  G<br>1441 CCCACAGCTGGCCCCACAGGTCCCCCCTCAGCTGGCCCACAGGTCCCCCACTGCTGGC<br> 501  P  S  T  A  T  T  V  P  L  S  P  V  D  D  A  C  N  V  N  I<br>1501 CCTTCTACGGCCACTACTGTGCCTTTGAGTCCGGTGACGATGCCTGCAACGTGAACATC<br> 521  F  D  A  I  A  E  I  G  N  Q  L  Y  L  F  K  D  G  K  Y  W<br>1561 TTCGACGCCATCGCGGAGATTGGGAACCAGCTGTATTTGTTCAAGGATGGGAAGTACTGG<br> 541  R  F  S  E  G  R  G  S  R  P  Q  G  P  F  L  I  A  D  K  W<br>1621 CGATTCTCTGAGGGCAGGGGGAGCCGGCCAGGGCCCCTTCCTTATCGCCGACAAGTGG<br> 561  P  A  L  P  R  K  L  D  S  V  F  E  E  P  L  S  K  K  L  F<br>1681 CCCGCGCTGCCCCGCAAGCTGGACTCGGTCTTTGAGGAGCCGCTCTCCAAGAAGCTTTTC<br> 581  F  F  S  G  R  Q  V  W  V  Y  T  G  A  S  V  L  G  P  R  R<br>1741 TTCTTCTCTGGGCGCCAGGTGTGGGTATACACAGGCGCGTCGGTGCTGGGCCCGAGGCGT<br> 601  L  D  K  L  G  L  G  A  D  V  A  Q  V  T  G  A  L  R  S  G<br>1801 CTGGACAAGCTGGGCCTGGGAGCCGACGTGGCCCAGGTGACCGGGGCCCTCCGGAGTGGC<br> 621  R  G  K  M  L  L  F  S  G  R  R  L  W  R  F  D  V  K  A  Q<br>1861 AGGGGGAAGATGCTGCTGTTCAGCGGGCGGCGCCTCTGGAGGTTCGACGTGAAGGCGCAG<br> 641  M  V  D  P  R  S  A  S  E  V  D  R  M  F  P  G  V  P  L  D<br>1921 ATGGTGGATCCCCGGAGCGCCAGCGAGGTGGACCGGATGTTCCCCGGGGTGCCTTTGGAC | SEQ ID NO: 36 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 661 T H D V F Q Y R E K A Y F C Q D R F Y W<br>1981 ACGCACGACGTCTTCCAGTACCGAGAGAAAGCCTATTCTGCCAGGACCGCTTCTACTGG<br>681 R V S S R S E L N Q V D Q V G Y V T Y D<br>2041 CGCGTGAGTTCCCGGAGTGAGTTGAACCAGGTGGACCAAGTGGGCTACGTGACCTATGAC<br>701 I L Q C P E D -<br>2101 ATCCTGCAGTGCCCTGAGGACTAG | |
| B1961438 | No homology | 1 GCACGAGGCAGCCAGCAGCTTTGGAGCCCCCACAACCTGGACACTCACATCGAAGTCTCT<br>61 GCCTAGCCACCCTCTCCCTGAGCCCATCTCAGATGCCCCTCCCCCCCAGGCTGCCAGGTG<br>121 GCTGGGGTGAGGTCAGGTGGCAGGCCCAGAATAGGCCCAGTCATCCACTCCCCTCCCTCT<br>181 CAGGATTGCAGGAGTCTGAGCTATTCCCGGCCACCTCTATCTCCCACCCCACCTTCTCCA<br>241 CCATAGCCAGGGGCTGGGCCCCGTAGGTGAAACAAGCGGGTGAAACCCCTCTGGGGCCCA<br>301 GACATGCAAACCTCTGGCACCACTGGGTCCTGGCTGAACCCCTGGGTGGTGTGCAGCTTC<br>361 CCCTCTGGTCTCAGTTTCCTTTCCTGAAAAGCGAGGAGTTGGAGGCAACGTTCTCCTCCT<br>421 GGCCTGTGGCCCTCAGAGGAGAAGGACTGGAAGGAACTTCAGAGAATCCTCACTCCCCTC<br>481 ATTTTACAGATGAGGAAACT | SEQ ID NO: 37 |
| | | Non contiguous<br>1 CCTTTCCTGAAAAGCGAGGAGTTGGAGGCAACGTTCTCCTCCTGGCCTGTGGCCCTCAGA<br>61 GGAGAAGGACTGGAAGGAACTTCAGAGAATCCTCACTCCCCTCATTTTACAGATGAGGAA<br>121 ACTGAGGCCCAGAGTGGGCAGAGACTTGGCATCATTGTCATCCAGCAAATAACAGAAGGG<br>181 AAGTTCCTTGGGGAAGAACCAGGAGCAGAGGTCTGGGGAGAGGTGGGCAAGGAGGGGGTC<br>241 AGTCTCCCCTAGTCCAGAAAAGGGCCTCACCTGCCAGGGGCCTCCAGTCTCTGGCCCTCT<br>301 GTCCTGCGCATTGCTTTCCAAGGAGCCTTCTTGAGGTCACTGCATTTGATCTTCATGGCG<br>361 GCACCTGGAAGAGAGACATGAGCGTTTGTGTTTGCTTTAAAAAAAGCATTTTTCATTTTA<br>421 AAAAATCAAGGTGTGCTTTGTAGACACTTTGGAAAGTTCAGGAGAGTAATCCAGGGTGGA<br>481 GTCTATGCAGAAATGACCCATAATCCAGCAACGCCAGGCCCCTGAGTGGTGGCTTCTATG<br>541 TAGCTGTAATCGTACTATACAT | SEQ ID NO: 38 |
| B1961550.V1.3_AT | Homo sapiens cDNA FLJ40597 fis, clone THYMU2011118 | 1 ATTGTTATCAACTCTTTGATATCTGATGATCAATGCTCCAAAGAATTGGATTAATATTTT<br>61 TACACAATATTGTTGTAGTCAGTAACTGTTTCTATTTCCAGGCATTTTTAGATGAATTCA<br>121 CTAACTGGTCAAGAATAAATCCCAACAAGGCCAGGATTCCCATGGCAGGAGATACCCAAG<br>181 GTGTGGTCGGGACTGTCTCTAAGCCTTGTTTCACAGCATATGAAATGAAAATCGGTGCAA<br>241 TTACTTTTCAGGTTGCTACTGGAGATATAGCCACTGAACAGGTAGATGTTATTGTAAACT<br>301 CAACAGCAAGGACATTTATCGGAAAATCAGGTGTGTCAAGAGCTATTTTAGAAGGTGCTG<br>361 GACAAGCTGTGGAAAGTGAATGTGCTGTACTAGCTGCACAGCCTCACAGAGATTTTATAA<br>421 TTACACCAGGTGGATGCTTAAAGTGCAAATAATAATTCATGTTCCTGGGGGAAAAGATG<br>481 TCAGGAAAACGGTCACCAGTGTTCTAGAGGAGTGTGAACAGAGGAAGTACACATCGGTTT<br>541 CCCTTCCAGCCATTGGAACAGGAAATGCCGGAAAAAACCCTATCACAGTTGCTGATAACA<br>601 TAATCGATGCTATTGTAGACATTCTTCCACCCCATCATTAAAAACAGTTA<br>661 AAGTTGTCATTTTTCAACCTGAGCTGCTAAATATATTCTACGACAGCATGAAAAAAGAG<br>721 ACCTCTCTGCATCACTGAACTTTCAGTCCACATTCTCCATGACTACATGTAATCTTCCTG<br>781 AACACTGGACTGACATGAATCATCAGCTGTTTTGCATGGTCCAGCTAGAGCCAGGACAAT<br>841 CAGAATATAATACCATAAAGGACAAGTTCACCCGAACTTGTTCTTCCCACGAAATAGAGA<br>901 AGATTGAGAGGATACAGAATGTATTTCTCTGGGAGAGCTACCAGGTAAAGAAAAACCACA<br>961 TGGACACCAAGAATGGCCATACCAATAACGAGAGACAACTCTTCCACGGCACAGATGCAG<br>1021 ACACAGTGCCGTACATCAATCAGCACGGCTTTAATCGCAGTTATGCTGGGAAGAACGCTA<br>1081 CAGTCTTTTGGAAAAGGAACTGTATTTCGCTGTTGATGCCAGTTATTCTGCTAACGATGCAT<br>1141 ACTCCAGAGCAGACAGCAGTGGGAGAAAGCATATTTACGTTGTGCGAGTACTTACAGGAG<br>1201 TCTACACAGTTGGACACGCAGCAATAAAAAGCCCTCCACCAAAGAACCCTGACAACCCTA<br>1261 CGGATCTGTTTGACTCTGTCACAGATGATACACGGCATCCAAAGCTATTTGTGGTATTCT<br>1321 CTGATCATCAAGCTTACCCAGAATATCTCATAACTTTCACGGCTAAAAATATTTTTATC<br>1381 ATCAAAGAGATGATTTAAGTCATCTGTAAGAACAACATGCAATCTTTGTCTTTGCTTCTG<br>1441 GCCTGTGTAAGCAGATGAAAGTTTCCCTTTTAGGTGCCAAAATGCTGAAAATTACCTTTT<br>1501 TAAAGTGCTCTATTGCTGCGATTTGTAGCATACCTTTTTTTCTCAGCAAATTGATGGGTG<br>1561 GAAGCTGAGAAATGTATGGTAAATGTCACAGAGCTACAACCATTCACAGACACCCAAATCT<br>1621 CTAGGAGAATAAAAAGCACATTATTCTTTTTCTATCAGAAAAAAACAAGATGCATCACCT<br>1681 TAAAACCAAGATGACATTGTTCTTCTTGGAACATGTTAAGACATCGAATGGTGGCGGGTT<br>1741 AAACTGTACTGCTTAAGTGGAGCGGCTACCGTTATGCATCTATCACAGTTGGGGATTTTG<br>1801 CCTTATTAAGGAAAACTTGTCAATAGTTCAGCTGAAATGACTGAATCACAGAATATTAAC<br>1861 TCTGTTATGGAACAAATCATAACAGATTTTACCTGTTTACATTTCAGGTAAAAATGTATC<br>1921 GCATTGTTATCTAATATTAAAAAATTACCCCCAATT | SEQ ID NO: 39 |
| | | 1 M L Q R I G L I F L H N I V V S N C F<br>1 ATGCTCCAAAGAATTGGATTAATATTTTTACACAATATTGTTGTAGTCAGTAACTGTTTC<br>21 Y F Q A F L D E F T N W S R I N P N K A<br>61 TATTTCCAGGCATTTTTAGATGAATTCACTAACTGGTCAAGAATAAATCCCAACAAGGCC<br>41 R I P M A G D T Q G V V G T V S K P C F<br>121 AGGATTCCCATGGCAGGAGATACCCAAGGTGTGGTCGGGACTGTCTCTAAGCCTTGTTTC<br>61 T A Y E M K I G A I T F Q V A T G D I A<br>181 ACAGCATATGAAATGAAAATCGGTGCAATTACTTTTCAGGTTGCTACTGGAGATATAGCC<br>81 T E Q V D V I V N S T A R T F N R K S G<br>241 ACTGAACACGTAGATGTTATTGTAAACTCAACAGCAAGGACATTTAATCGGAAATCAGGT | SEQ ID NO: 40 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 101  V  S  R  A  I  L  E  G  A  G  Q  A  V  E  S  E  C  A  V  L<br>301 GTGTCAAGAGCTATTTTAGAAGGTGCTGGACAAGCTGTGGAAAGTGAATGTGCTGTACTA<br>121  A  A  Q  P  H  R  D  F  I  I  T  P  G  G  C  L  K  C  K  I<br>361 GCTGCACAGCCTCACAGAGATTTTATAATTACACCAGGTGGATGCTTAAAGTGCAAAATA<br>141  I  I  H  V  P  G  G  K  D  V  R  K  T  V  T  S  V  L  E  E<br>421 ATAATTCATGTTCCTGGGGAAAAGATGTCAGGAAAACGGTCACCAGTGTTCTAGAAGAG<br>161  C  E  Q  R  K  Y  T  S  V  S  L  P  A  I  G  T  G  N  A  G<br>481 TGTGAACAGAGGAAGTACACATCGGTTTCCCTTCCAGCCATTGGAACAGGAAATGCCGGA<br>181  K  N  P  I  T  V  A  D  N  I  I  D  A  I  V  D  F  S  S  Q<br>541 AAAAACCCTATCACAGTTGCTGATAACATAATCGATGCTATTGTAGACTTCTCATCACAA<br>201  H  S  T  P  S  L  K  T  V  K  V  V  I  F  Q  P  E  L  L  N<br>601 CATTCCACCCCATCATTAAAAACAGTTAAAGTTGTCATTTTTCAACCTGAGCTGCTAAAT<br>221  I  F  Y  D  S  M  K  K  R  D  L  S  A  S  L  N  F  Q  S  T<br>661 ATATTCTACGACAGCATGAAAAAAGAGACCTCTCTGCATCACTGAACTTTCAGTCCACA<br>241  F  S  M  T  T  C  N  L  P  E  H  W  T  D  M  N  H  Q  L  F<br>721 TTCTCCATGACTACAFGTAATCTTCCTGAACACTGGACTGACATGAATCATCAGCTGTTT<br>261  C  M  V  Q  L  E  P  G  Q  S  E  Y  N  T  I  K  D  K  F  T<br>781 TGCATGGTCCAGCTAGAGCCAGGACAATCAGAATATAATACCAFAAAGGACAAGTTCACC<br>281  R  T  C  S  S  H  E  I  E  K  I  E  R  I  Q  N  V  F  L  W<br>841 CGAACTTGTTCTTCCCACGAAATAGAGAAGATTGAGAGGATACAGAATGTATTTCTCTGG<br>301  E  S  Y  Q  V  K  K  N  H  M  D  T  K  N  G  H  T  N  N  E<br>901 GAGAGCTACCAGGTAAAGAAAAACCACATGGACACCAAGAATGGCCATACCAATAACGAG<br>321  R  Q  L  F  H  G  T  D  A  D  T  V  P  Y  I  N  Q  H  G  F<br>961 AGACAACTCTTCCACGGCACAGATGCAGACACAGTGCCGTACATCAATCAGCACGGCTTT<br>341  N  R  S  Y  A  G  K  N  A  T  V  F  G  K  G  T  V  F  A  V<br>1021 AATCGCAGTTATGCTGGGAAGAACGCTACAGTCTTTGGAAAAGGAACGTATTTCGCTGTT<br>361  D  A  S  Y  S  A  N  D  A  Y  S  R  A  D  S  S  G  R  K  H<br>1081 GATGCCAGTTATTCTGCTAACGATGCATACTCCAGAGCAGACAGCAGTGGGAGAAAGCAT<br>381  I  Y  V  V  R  V  L  T  G  V  Y  T  V  G  H  A  A  I  K  S<br>1141 ATTTACGTTGTGCGAGTACTTACAGGAGTCTACACAGTTGGACACGCAGCAATAAAAAGC<br>401  P  P  P  K  N  P  D  N  P  T  D  L  F  D  S  V  T  D  D  T<br>1201 CCTCCACCAAAGAACCCTGACAACCCTACGGATCTGTTTGACTCTGTCACAGATGATACA<br>421  R  H  P  K  L  F  V  V  F  S  D  H  Q  A  Y  P  E  Y  L  I<br>1261 CGGCATCCAAAGCTATTTGTGGTATTCTCTGATCATCAAGCTTACCCAGAAAATCTCATA<br>441  T  F  T  A  -<br>1321 ACTTTCACGGCTTAA | |
| BM4734862.V1.3_AT | Homo sapiens triggering receptor expressed on myeloid cells 1, mRNA | 1 GTCCCGGGAGCCCTCAGCAGCAGTTGGAGCTGGTGCACAGGAAGGATGAGGAAGACCAGG<br>61 CTCTGGGGGCTGCTGTGGATGCTCTTTGTCTCAGAACTCCGAGCTGCAACTAAATTAACT<br>121 GAGGAAAAGTATGAACTGAAAGAGGGGCAGACCCTGGATGTGAAATGTGACTACACGCTA<br>181 GAGAAGTTTGCCAGCAGCCAGAAAGCTTGGCAGATAATAAGGGACGGAGAGATGCCAAG<br>241 ACCCTGGCATGCACAGAGAGGCCTTCAAAGAATTCCCATCCAGTCCAAGTGGGGAGGATC<br>301 ATACTAGAAGACTACCATGATCATGGTTTACTGCGCGTCCGAATGGTCAACCTTCAAGTG<br>361 GAAGATTCTGGACTGTATCAGTGTGTGATCTACCAGCCTCCCAAGGAGCCTCACATGCTG<br>421 TTCGATCGCATCCGCTTGGTGGTGACCAAGGGTTTTTCAGGGACCCCTGGCTCCAATGAG<br>481 AATTCTACCCAGAATGTGTATAAGATTCCTCCTACCACCACTAAGGCCTTGTGCCCACTC<br>541 TATACCAGCCCCAGAACTGTGACCCAACCCCCACCCAAGTCAACTGCCGGTGTCTCCCGC<br>601 CCTGGACTTGAAGTCAACCCCACACATGTGACAGACGTCACCAAAATCTCTGTGTTCAGC<br>661 ATTGTCATTCCTGTGGCGTGCGCACTCGTGACTAAGAGCCTGGTCCTTACTGTCCTGTTT<br>721 GCTGTCACACAGAAGTCATTTGGATCCTAGGCCCATGGACCCATGAGGATGACCTCTGAT<br>781 CTCCATCTACATCCATCTGGCAGTTGTGCCAAGGGAGGAGGAGGAGGTAAAAGGCAGGG<br>841 AGTAATAACATGAATTAATCTGTAATCACCGCCAAAAAA<br>901 AAAAA | SEQ ID NO: 41 |
| | | 1  M  R  K  T  R  L  W  G  L  L  W  M  L  F  V  S  E  L  R  A<br>1 ATGAGGAAGACCAGGCTCTGGGGGCTGCTGTGGATGCTCTTTGTCTCAGAACTCCGAGCT<br>21  A  T  K  L  T  E  E  K  Y  E  L  K  E  G  Q  T  L  D  V  K<br>61 GCAACTAAATTAACTGAGGAAAAGTATGAACTGAAAGAGGGGCAGACCCTGGATGTGAAA<br>41  C  D  Y  T  L  E  K  F  A  S  S  Q  K  A  W  Q  I  I  R  D<br>121 TGTGACTACACGCTAGAGAAGTTTGCCAGCAGCCAGAAAGCTTGGCAGATAATAAGGGAC<br>61  G  E  M  P  K  T  L  A  C  T  E  R  P  S  K  N  S  H  P  V<br>181 GGAGAGATGCCAAGACCCTGGCATGCACAGAGAGGCCTTCAAAGAATTCCCATCCAGTC<br>81  Q  V  G  R  I  I  L  E  D  Y  H  D  H  G  L  L  R  V  R  M<br>241 CAAGTGGGAGGATCATACTAGAAGACTACCATGATCATGGTTTACTGCGCGTCCGAATG<br>101  V  N  L  Q  V  E  D  S  G  L  Y  Q  C  V  I  V  Q  P  P  K<br>301 GTCAACCTTCAAGTGGAAGATTCTGGACTGTATCAGTGTGTGATCTACCAGCCTCCCAAG<br>121  E  P  H  M  L  F  D  R  I  R  L  V  V  T  K  G  F  S  G  T<br>361 GAGCCTCACATGCTGTTCGATCGCATCCGCTTGGTGGTGACCAAGGGTTTTTCAGGGACC<br>141  P  G  S  N  E  N  S  T  Q  N  V  Y  K  I  P  P  T  T  T  K<br>421 CCTGGCTCCAATGAGAATTCTACCCAGAATGTGTATAAGATTCCTCCTACCACCACTAAG<br>161  A  L  C  P  L  Y  T  S  P  R  T  V  T  Q  P  P  P  K  S  T<br>481 GCCTTGTGCCCACTCTATACCAGCCCCAGAACTGTGACCCAACCCCCACCCAAGTCAACT | SEQ ID NO: 42 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 181 A G V S R P G L E V N P T H V T D V T R<br>541 GCCGGTGTCTCCCGCCCTGGACTTGAAGTCAACCCCACACATGTGACAGACGTCACCAGG<br>201 I S V F S I V I P V A C A L V T K S L V<br>601 ATCTCTGTGTTCAGCATTGTCATTCCTGTGGCGTGCGCACTCGTGACTAAGAGCCTGGTC<br>221 L T V L F A V T Q K S F G S -<br>661 CTTACTGTCCTGTTTGCTGTCACACAGAAGTCATTTGGATCCTAG | |
| WBC041B04_V1.3_AT | Human mRNA for 56-KDa protein induced by interferon. | 1 CCAGATCTCAGAGGAGCCTGGCTAAGCAAAACCCTGCAGAACGGCTGCCTAATTTACAGC<br>61 AACCATGAGTACAAATGGTGATGATCATCAGGTCAAGGATAGTCTGGAGCAATTGAGATG<br>121 TCACTTTACATGGGAGTTATCCATTGATGACGATGAAATGCCTGATTTAGAAAACAGAGT<br>181 CTTGGATCAGATTGAATTCCTAGACACCAAATACAGTGTGGGAATACACAACCTACTAGC<br>241 CTATGTGAAACACCTGAAAGGCCAGAATGAGGAAGCCCTGAAGAGCTTAAAAGAAGCTGA<br>301 AAACTTAATGCAGGAAGAACATGACAACCAAGCAAATGTGAGGAGTCTGGTGACCTGGGG<br>361 CAACTTTGCCTGGATGTATTACCACATGGGCAGACTGGCAGAAGCTCAGACTTACCTGGA<br>421 CAAGGTGGAGAACACTTGCAAGAAGTTTGCAAATCCCTCCAGCTATAGAATCGACTGTCC<br>481 TCAGATGGACTGTGAGGAAGGATGGGCCTTGCTGAAATGTGGAGGAAAGAATTATAAACG<br>541 GGCCAAGGCCTGCTTTGAAAAGGCTCTGGAAGTGGACCCAGAAAACCCTGAATTCAGCAC<br>601 TGGGTATGCAATCACCGCCTATCGCCTGGACGGCTTTAAATTAGCCACAAAAAATCACAA<br>661 GCCATTTTCTTTGCTTCCCCTAAGGCAGGCTGTCCGCTTAAATCCAGACAATGGATATAT<br>721 TAAGGTTCTCCTTGCCCTGAAGCTTCAGGATGTAGGACAAGAAGCTGAAGGAGAAAAGTA<br>781 CATTGAAGAAGCGCTGACCAACACGTCCTCGCAGACCTATGTCCTTCGATATGCGGCCAA<br>841 GTTTTACAGAAAAAAGGCTCTCTGGATAAAGCTCTTCAGCTCTTTAAAAAGGCCTTGAA<br>901 AGCAACACCCTCCTCTGCCTTCGTGCATCACCAGATAGGGCTTTGCTACAGAGGACAAGT<br>961 GATTCAAATGAAGAAAGCTGCAAACTGGCAGCCTAGAGGACAGGATAGAAAAAATGTTGA<br>1021 GAGAATTGCAAGATTAGCCATATCTCATTTGGAATTTGCTCTGGAAGAAAAACCCACACT<br>1081 TGATATTGCTTATGTAGACCTGGCAGAAATGTATATAGAAGCAGGTGACCACAGAAAAGC<br>1141 TGAAGACACTTATCAAAAAGTGTTAACCATGAAAGTACTCGAAGAGAAAAAGCTGCAAAG<br>1201 GGTACATTTCTCCTATGGCCGATTTCAGGAATTTCTAAATAAATCTGAAGACCATGCAAA<br>1261 TATCCATTATTTAAAAGCAGCAGAAATAGAAAACGCATCTTTTCTAAGAGATAAAGTAT<br>1321 CAGGTCTTTGGAGAAATTGGCTTTAAAGAAACTTCAGAGAAACCAGTGGTAGAAGAAACA<br>1381 ATGCAAGACATACATTTCTACTATGGTCGGTTTCAGGAATTTCAAAAGAAATCTGACGTC<br>1441 AATGCAATTATCCATTATTTAAAAGCTATAAAAATAGAACAGGCATCATTAACAAGGGAT<br>1501 AAAAGTATCAATTCTTTGAAGAAATTGGTTTTAAGGAAACTTCGGAGAAAGGCATTAGAT<br>1561 CTGGAAAGCTTGAGCCTCCCTTGGTTCGTCTACAAATTGGAAGGAAATATGAATGAAGCC<br>1621 CTGGAGTACTATGAGCGGGCCCTGAGACTGGCTGCTGACTTTGAGAACTCTGTGAGACAA<br>1681 GGTCCTTAGGCACCCAGATATCAGCCACTTTCACATTTTATGTTAACACATACTAATCAT<br>1741 CTTACCTGCTTGCTGCTTCAGAACATGTTATGTAATTTACTGTAATGATGCAATTTTTG<br>1801 AATAATAAATCTGACAAAATATT | SEQ ID NO: 43 |
| | | 1 M S T N G D D H Q V K D S L E Q L R C H<br>1 ATGAGTACAAATGGTGATGATCATCAGGTCAAGGATAGTCTGGAGCAATTGAGATGTCAC<br>21 F T W E L S I D D D E M P D L E N R V L<br>61 TTTACATGGGAGTTATCCATTGATGACGATGAAATGCCTGATTTAGAAAACAGAGTCTTG<br>41 D Q I E F L D T K Y S V G I H N L L A Y<br>121 GATCAGATTGAATTCCTAGACACCAAATACAGTGTGGGAATACACAACCTACTAGCCTAT<br>61 V K H L K G Q N E E A L K S L K E A E N<br>181 GTGAAACACCTGAAAGGCCAGAATGAGGAAGCCCTGAAGAGCTTAAAAGAAGCTGAAAAC<br>81 L M Q E E H D N Q A N V R S L V T W G N<br>241 TTAATGCAGGAAGAACATGACAACCAAGCAAATGTGAGGAGTCTGGTGACCTGGGGCAAC<br>101 F A W M Y Y H M G R L A E A Q T Y L D K<br>301 TTTGCCTGGATGTATTACCACATGGGCAGACTGGCAGAAGCTCAGACTTACCTGGACAAG<br>121 V E N T C K K F A N P S S Y R I D C P Q<br>361 GTGGAGAACACTTGCAAGAAGTTTGCAAATCCCTCCAGCTATAGAATCGACTGTCCTCAG<br>141 M D C E E G W A L L K C G G K N Y K R A<br>421 ATGGACTGTGAGGAAGGATGGGCCTTGCTGAAATGTGGAGGAAAGAATTATAAACGGGCC<br>161 K A C F E K A L E V D P E N P E F S T G<br>481 AAGGCCTGCTTTGAAAAGGCTCTGGAAGTGGACCCAGAAAACCCTGAATTCAGCACTGGG<br>181 Y A I T A Y R L D G F K L A T K N H K P<br>541 TATGCAATCACCGCCTATCGCCTGGACGGCTTTAAATTAGCCACAAAAAATCACAAGCCA<br>201 F S L L P L R Q A V R L N P D N G Y I K<br>601 TTTTCTTTGCTTCCCCTAAGGCAGGCTGTCCGCTTAAATCCAGACAATGGATATATTAAG<br>221 V L L A L K L Q D V G Q E A E G E K Y I<br>661 GTTCTCCTTGCCCTGAAGCTTCAGGATGTAGGACAAGAAGCTGAAGGAGAAAAGTACATT<br>241 E E A L T N T S S Q T Y V L R Y A A K F<br>721 GAAGAAGCGCTGACCAACACGTCCTCGCAGACCTATGTCCTTCGATATGCGGCCAAGTTT<br>261 Y R K K G S L D K A L Q L F K K A L K A<br>781 TACAGAAAAAAGGCTCTCTGGATAAAGCTCTTCAGCTCTTTAAAAAGGCCTTGAAAGCA<br>281 T P S S A F V H H Q I G L C Y R G Q V I<br>841 ACACCCTCCTCTGCCTTCGTGCATCACCAGATAGGGCTTTGCTACAGAGGACAAGTGATT<br>301 Q M K K A A N W Q P R G Q D R K N V E K<br>901 CAAATGAAGAAAGCTGCAAACTGGCAGCCTAGAGGACAGGATAGAAAAAATGTTGAGAAG<br>321 I A R L A I S H L E F A L E E K P T L D<br>961 ATTGCAAGATTAGCCATATCTCATTTGGAATTTGCTCTGGAAGAAAAACCCACACTTGAT | SEQ ID NO: 44 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 341 I A Y V D L A E M Y I E A G D H R K A E<br>1021 ATTGCTTATGTAGACCTGGCAGAAATGTATATAGAAGCAGGTGACCACAGAAAAGCTGAA<br>361 D T Y Q K V L T M K V L E E E K L Q R V<br>1081 GACACTTATCAAAAAGTGTTAACCATGAAAGTACTCGAAGAAGAAAAGCTGCAAAGGGTA<br>381 H F S Y G R F Q E F Q N K S E D H A I I<br>1141 CATTTCTCCTATGGCCGATTTCAGGAATTTCAAAATAAATCTGAAGACCATGCAATTATC<br>401 H Y L K A A E I E N A S F L R D K S I R<br>1201 CATTATTTAAAAGCAGCAGAAATAGAAAACGCATCTTTTCTAAGAGATAAAAGTATCAGG<br>421 S L E K L A L K K L Q R N Q W -<br>1261 TCTTTGGAGAAATTGGCTTTAAAGAAACTTCAGAGAAACCAGTGGTAG | |
| WBC422.GRSP.V1.3_AT | Homo sapiens guanylate binding protein 5, mRNA. | 1 CTCCAGGCTGTGGAACCTTTGTTCTTTCACTCTTTGCAATAAATCTTGCTGCTGCTCACT<br>61 CTTTGGGTCCACACTGCCTTTATGAGCTGTAACACTCACTGGGAATGTCTGCAGCTTCAC<br>121 TCCTGAAGCCAGCGAGACCACGAACCCACCAGGAGGAACAAACAACTCCAGACGCGCAGC<br>181 CTTAAGAGCTGTAACACTCACCGCGAAGGTCTGCAGCTTCACTCCTGAGCCAGCCAGACC<br>241 ACGAACCCACCAGAAGGAAGAAACTCCAAACACATCCGAACATCAGAAGGAGCAAACTCC<br>301 TGACACGCCACCTTTAAGAACCGTGACACTCAACGCTAGGGTCCGCGGCTTCATTCTTGA<br>361 AGTCAGTGAGACCAAGAACCCACCAATTCCGGACACGCTAATTGTTGTAGATCATCACTT<br>421 CAAGGTGCCCATATCTTTCTAGTGGAAAAATTATTCTGGCCTCCGCTGCATACAAATCAG<br>481 GCAACCAGAATTCTACATATATAAGGCAAAGTAACATCCTAGACATGCTTTAGAGATCC<br>541 ACATGTCAGACCCCATGTGCCTCATCGAGAACTTTAATGAGCAGCTGAAGGTTAATCAGG<br>601 AAGCTTTGGAGATCCTGTCTGCCATTACGCAACCTGTAGTTGTGGTAGCGATTGTGGGCC<br>661 TCTATCGCACTGGCAAATCCTACCTGATGAACAAGCTGGCTGGGAAGAACAAGGGCTTCT<br>721 CTGTTGCATCTACGGTGCAGTCTCACACCAAGGGAATTTGGATATGGTGTGTGCCTCATC<br>781 CCAACTGGCCAAATCACACATTAGTTCTGCTTGACACCGAGGGCCTGGGAGATGTAGAGA<br>841 AGGCTGACAACAAGAATGATATCCAGATCTTTGCACTGGCACTCTTACTGAGCAGCACCT<br>901 TTGTGTACAATACTGTGAACAAAATTGATCAGGGTGCTATCGACCTACTGCACAATGTGA<br>961 CAGAACTGACAGATCTGCTCAAGGCAAGAAACTCACCCGACCTTGACAGGGTTGAAGATC<br>1021 CTGCTGACTCTGCGAGCTTCTTCCCAGACTTAGTGTGGACTCTGAGAGATTTCTACCTAG<br>1081 CCCTGGAAGCAGATGGGCAACTCGTCACAGCCGATGAATACCTGGAGAATTCGCTGAGGC<br>1141 AAAAGCAAGGCACCGATCGAAGTCTCCAAAATTTCAATTTGCCCCGTCTGTGTATACAGA<br>1201 AATTCTTTCCAAGAAAGAAATGCTTTATTTTTGACTTGCCCACTCACCGGAAGAAGCTTG<br>1261 CCCACCTCGAGACACTGCATAATGATGAGCTGGATTCTGACTTTGTGCAACAAGTGGCAG<br>1321 AATTCTGTTCATACGTTCTTCAAGCATTCCAAGACTAAAACCCTTTCAGGAGGCATTAAG<br>1381 TCAATGGACCTCAATTAGAGAGCCTGGTGCTGACCTATGTCAACGCCATCAGCCGTGGGT<br>1441 ATCTGCCCTGCATGGAGAACTCAGTCTTTGGCCTTGGCTCAGATCAAGAACTCAGCAGCAG<br>1501 TGCAAAAGGCCATTGCTCACTATGACCAGCAGATGGGCCGGAAGCTGCAGCTGCCCACGG<br>1561 AAACCCTCCAGGAGCTGCTAGACCTGCACAGGGCCAGTGAGAAAGAAGCCATTGCCGTCT<br>1621 TCATGAAGAACTCTTTCAAGGATGTGAACCAAAGTTTCCAGAAAAAATTACGGACCCAGC<br>1681 TAGAAGCAAAACAGGATGACTTTTATCAACAGAACTTGGAGGCAFCACTGGATCGTTGCT<br>1741 CAGCTTTACTTCAGGATCTTTTTGGTCCTCTAGAAGAAGCAGTGAAGCAGGGAATTTATT<br>1801 CTAAGCCAGGAGGCCATAATCTCTTCATTCAGAAAACAGAAGAACTGAAGGCAAAGTACT<br>1861 ATCGGGAGCCTCGGAAAGGAATACAGGCTGAAGAAGTTCTGCAGAAATATTTAAAGTCCA<br>1921 AGGAGTCTGTGAGTCATGCAATATTACAGACTGACCAGGCTCTCACAGAGACGGAAAAAA<br>1981 AGAAGAAAGAGGCACAAGTGAAAGCAGAAGCTGAAAAGGCTGAAGCGCAAAGGTTGGCGG<br>2041 CGATTCAAAGGCAGAACGAGCAAATGATGCAGGAGGGGAGAGACTCCATCAGGAACAAG<br>2101 TGAGACAAATGGAGATAGCCAAACAAAATTGGCTGGCAGAGCAACAGAAAATGCAGGAAC<br>2161 AACAGATGCAGGAACAGGCTGCACAGCTCAGCACAACATTCCAAGCTCAAAATAGAAGCC<br>2221 TTCTCAGTGAGCTCCAGCACGCCCAGAGGACTGTTAATAACGATGATCCATGTGTTTTAC<br>2281 TCTAAAGTGCTAAATATGGGAGTTTCCTTTTTTTACTCTTTGTCACTGATGACACAACAG<br>2341 AAAAGAAACTGTAGACCTTGGGACAATCAACATTTAAATAAACTTTATAATTATTTTTC<br>2401 AAACTTTAAAAAAAAAAAAAAAAAAAAAAA | SEQ ID NO: 45 |
| | | 1 M A L E I H M S D P M C L I E N F N E Q<br>1 ATGGCTTTAGAGATCCACATGTCAGACCCCATGTGCCTCATCGAGAACTTTAATGAGCAG<br>21 L K V N Q E A L E I L S A I T Q P V V V<br>61 CTGAAGGTTAATCAGGAAGCTTTGGAGATCCTGTCTGCCATTACGCAACCTGTAGTTGTG<br>41 V A I V G L Y R T G K S Y L M N K L A G<br>121 GTAGCGATTGTGGGCCTCTATCGCACTGGCAAATCCTACCTGATGAACAAGCTGGCTGGG<br>61 K N K G F S V A S T V Q S H T K G I W I<br>181 AAGAACAAGGGCTTCTCTGTTGCATCTACGGTGCAGTCTCACACCAAGGGAATTTGGATA<br>81 W C V P H P N W P N H T L V L L D T E G<br>241 TGGTGTGTGCCTCATCCCAACTGGCCAAATCACACATTAGTTCTGCTTGACACCGAGGGC<br>101 L G D V E K A D N K N D I Q I F A L A L<br>301 CTGGGAGATGTAGAGAAGGCTGACAACAAGAATGATATCCAGATCTTTGCACTGGCACTC<br>121 L L S S T F V Y N T V N K I D Q G A I D<br>361 TTACTGAGCAGCACCTTTGTGTACAATACTGTGAACAAAATTGATCAGGGTGCTATCGAC<br>141 L L H N V T E L T D L L K A R N S P D L<br>421 CTACTGCACAATGFGACAGAACTGACAGATCTGCTCAAGGCAAGAAACTCACCCGACCTT<br>161 D R V E D P A D S A S F F P D L V W T L<br>481 GACAGGGTTGAAGATCCTGCTCACTCTGCGAGCTTCTTCCCAGACTTAGTGTGGACTCTG<br>181 R D F Y L A L E A D G Q L V T A D E Y L<br>541 AGAGATTTCTACCTAGCCCTGGAAGCAGATGGGCAACTCGTCACAGCCGATGAATACCTG | SEQ ID NO: 46 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 201 E N S L R Q K Q G T D R S L Q N F N L P<br>601 GAGAATTCGCTGAGGCAAAAGCAAGGCACCGATCGAAGTCTCCAAAATTTCAATTTGCCC<br>221 R L C I Q K F F P R K K C F I F D L P T<br>661 CGTCTGTGTATACAGAAATTCTTTCCAAGAAAGAAATGCTTTATTTTTGACTTGCCCACT<br>241 H R K K L A H L E T L H N D E L D S D F<br>721 CACCGGAAGAAGCTTGCCCACCTCGAGACACTGCATAATGATGAGCTGGATTCTGACTTT<br>261 V Q Q V A E F C S Y V F K H S K T K T L<br>781 GTGCAACAAGTGGCAGAATTCTGTTCATACGTCTTCAAGCATTCCAAGACTAAAACCCTT<br>281 S G G I K V N G P Q L E S L V L T Y V N<br>841 TCAGGAGGCATTAAAGTCAATGGACCTCAATTAGAGAGCCTGGTGCTGACCTATGTCAAC<br>301 A I S R G Y L P C M E N S V L A L A Q I<br>901 GCCATCAGCCGTGGGTATCTGCCCTGCATGGAGAACTCAGTCTTGGCCTTGGCTCAGATC<br>321 K N S A A V Q K A I A H Y D Q Q M G R K<br>961 AAGAACTCAGCAGCAGTGCAAAAGGCCATTGCTCACTATGACCAGCAGATGGGCCGGAAG<br>341 L Q L P T E T L Q E L L D L H R A S E K<br>1021 CTGCAGCTGCCCACGGAAACCCTCCAGGAGCTGCTAGACCTGCACAGGGCCAGTGAGAAA<br>361 E A I A V F M K N S F K D V N Q S F Q K<br>1081 GAAGCCATTGCCGTCTTCATGAAGAACTCTTTCAAGGATGTGAACCAAAGTTTCCAGAAA<br>381 K L R T Q L E A K Q D D F Y Q Q N L E A<br>1141 AAATTACGGACCCAGCTAGAAGCAAAACAGGATGACTTTTATCAACAGAACTTGGAGGCA<br>401 S L D R C S A L L Q D L F G P L E E A V<br>1201 TCACTGGATCGTTGCTCAGCTTACTTCAGGATCTTTTTGGTCCTCTAGAAGAAGCAGTG<br>421 K Q G I Y S K P G G H N L F I Q K T E E<br>1261 AAGCAGGGAATTTATTCTAAGCCAGGAGGCCATAATCTCTTCATTCAGAAAACAGAAGAA<br>441 L K A K Y Y R E P R K G I Q A E E V L Q<br>1321 CTGAAGGCAAAGTACTATCGGGAGCCTCGGAAAGGAATACAGGCTGAAGAAGTTCTGCAG<br>461 K Y L K S K E S V S H A I L Q T D Q A L<br>1381 AAATATTTAAAGTCCAAGGAGTCTGTGAGTCATGCAATATTACAGACTGACCAGGCTCTC<br>481 T E T E K K K E A Q V K A K A E K A E<br>1441 ACAGAGACGGAAAAAAAGAAGAAAGAGGCACAAGTGAAAGCAGAAGCTGAAAAGGCTGAA<br>501 A Q R L A A I Q R Q N E Q M M Q E R E R<br>1501 GCGCAAAGGTTGGCGGCGATTCAAAGGCAGAACGAGCAAATGATGCAGGAGAGGGAGAGA<br>521 L H Q E V R Q M E I A K Q N W L A E Q<br>1561 CTCCATCAGGAACAAGTGAGACAAATGGAGATAGCCAAACAAAATTGGCTGGCAGAGCAA<br>541 Q K M Q E Q Q M Q E Q A A Q L S T T F Q<br>1621 CAGAAAATGCAGGAACAACAGATGCAGGAACAGGCTGCACAGCTCAGCACAACATTCCAA<br>561 A Q N R S L L S E L Q H A Q R T V N N D<br>1681 GCTCAAAATAGAAGCCTTCTCAGTGAGCTCCAGCACGCCCAGAGGACTGTTAATAACGAT<br>581 D P C V L L -<br>1741 GATCCATGTGTTTTACTCTAA | |
| WBC007E09 | Homo sapiens sterol-C5-desaturase (ERG3 delta-5-desaturase homolog, fungal)-like, transcript variant 2 | 1 AGAGACTTCAGCGCCTGGGACTCGGGTGGGCGAGGCGGAAGGTGTCCTCGCAGCACGGCT<br>61 TTTCTCCGCGCCGCGGTTGGTTAGCGAGTGCCCTCTGGGTGCTAGGCGTTGGGCGGATGG<br>121 TAGGATCGCGGTAGCATACGGATCCGATCCTGCGCCGAGTGAGAGGAGAGGCTGGCAGG<br>181 GGCTAAGTGATGGATCTTGTAC&CCGTGTTGCAGATTACTATTTTTTTACACCATACGTG<br>241 TATCCAGCCACATGGCCAGAAGATGACATCTTCCGACAAGCTATTAGTCTTCTGATTGTA<br>301 ACAAATGTTGGTGCTTACATCCTTTATTTCTTCTGTGCAACACTGAGCTATTATTTGTC<br>361 TTCGATCATGCATTAATGAAACATCCACAATTTTTAAAGAATCAAGTCCGTCGAGAGATT<br>421 AAGTTTACTGTCCAGGCATTGCCATGGATAAGTATTCTTACTGTTGCACTGTTCTTGCTG<br>481 GAGATAAGAGGTTACAGCAAATTACATGATGACCTAGGAGAGTTTCCATATGGATTGTTT<br>541 GAACTTGTCGTTAGTATAATATCTTTCCTCTTTTTCACTGACATGTTCATCTACTGGATT<br>601 CACAGAGGCCTTCATCATAGACTGGTATATAAGCGCCTACATAAACCTCACCATATTTGG<br>661 AAGATTCCTACTCCATTTGCAAGTCATGCTTTTCACCCTATTGATGGCTTTCTTCAGAGT<br>721 CTACCTTACCATATATACCCTTTTATCTTTCCATTACACAAGGTGGTTTATTTAAGTCTG<br>781 TACATCTTGGTTAATATCTGGACAATTTCCATTCATGACGGTGATTTTCGTGTCCCCCAA<br>841 ATCTTACAGCCATTTATTAATGGCTCACCTCATCATACAGACCACCATATGTCTTTGAC<br>901 TATAATTATGGACAATATTTCACTTTGTGGGATAGGATTGGCGGCTCATTCAAAAATCCT<br>961 TCATCCTTTGAGGGGAAGGGACCGCTCAGTTATGTGAAGGAGATGACAGAGGGAAAGCGC<br>1021 AGCAGCCATTCAGGAAATGGCTGTAAGAATGAAAAATTATTCAATGGAGAGTTTACAAAG<br>1081 ACTGAATAGATTATTGCCCAGTTATTCTTAAGTAAGGACAAAGAAGGAAATATCATCGTA<br>1141 TTTCTTTTTTTTAATAAGGAAAAAATAATATCCATACAGTCAAGATACATAGTAAATGGT<br>1201 AFCATTTGGAAATCAGCATCGTGGGCACTGCTGAGGAATGATCCTAGTGGTAGGTCAGAA<br>1261 GAAGATGCTGTGAACACCAGGACTTTAATCTTATGCTTAAAATGCCAGATGTTGTTCGGG<br>1321 GGACAACTTGTATCWTTCTAGCAGCAGATCTGTAGTTTGTATAGCCTCAACAACAATTTT<br>1381 AAATAAGATGGAGAATAAATTATTGAGGGGACTAGGCTATATGCATTTGCCTTCATCCAC<br>1441 CCATGTTTATTAAGAATCATTGTGCTTAATAATACCAAGACTAAGCACCATAACCAAGAA<br>1501 ATACTAAFGTAAAGATTGTTTCTTGTTTCAGGAATGGTTAATTCTTCAACGTTGGTATGA<br>1561 TAATGATAACTTGTTTTGACTTGAATAAAGTACTACATCAGTGTGGAAAAAAATTCTGAT<br>1621 ACATTAGCAGCTATGTAAATGACCTAATTGATAGCAGGTGTAATAAGACTATTCGTCTTCC<br>1681 TACACATAGGAGGCTCATTCTCTGGACACACTATCCACCTATTACATTTTACTGATTAACA<br>1741 AATAAATTGGAATTTAAAAATATCGATATCACCATGATTTAATCCAGATCTGGGATTATG<br>1801 TAGCTAAACATTGTGATGATTATTATTTAAAACCATTATTTAATAAGAGTAAAAATATGT<br>1861 GAATCTGGATATATTTAAAAAAAGAAATTTGATGCCCAGATAATATATTAGGCACTACTG<br>1921 ATTTTTTAGTTAAATTGATGCACThCACTTTTGATGTTTGAAGTTACAAACCTGTAATTT | SEQ ID NO: 47 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 1981 TTTTGTAAAGGAAATAATTGCCAAATACCTAGGCCCATTGCTGACGATTAGTTCTAAAAT<br>2041 CTTATTCCTCCTCTTCTCCCCTCACTTTTCCCTACTTCCTCTGCAAAAGATTTAACAAA<br>2101 TACATTCATAAGGAAATGTGTGTTGTAACAAATATATTGCAAAAACATAGTTTGTAAAGG<br>2161 CATTCTATAAGCTATTTATGTAAAATCAATAAAAGTTGATCATAATTAAAAAAAAAAAA<br>2221 AAAAAAAA<br><br>1 MDLVLRVADYYFFTPYVYPATWPEDDIFRQAISLLIVTNVGAYILYFFCATLSYYFVFDE<br>61 ALMKHPQFLKNQVRDEIKFTVQALPWISILTVALFLLEIRGYSKLHDDLGEFPYGLFELV<br>121 VSIISFLFFTDMFIYWIHRGLHHRLVYKRLHKPHHIWKIPTPFASHAFHPIDGFLQSLPY<br>181 HIYPFIFPLHKVVYLSLYILVNIWIISIHDGDFRVPQILQPFINGSAHHTDHHMFFDYNY<br>241 GQYFTLWDRIGGSFKNPSSFEGKGPLSYVKEMTEGKRSSHSGNGCKNEKLFNGEFTKTE- | SEQ ID NO: 48 |
| BM735031.V1.3_AT | Homo sapiens N-myc (and STAT) interactor, mRNA (cDNA clone MGC: 5050 IMAGE: 3452659). | 1 GGCGCGCTGGGCCTTGGGGAGCTGCGCTCGGCGGGCGGACGCGGGGGATCATGGAAGCTG<br>61 ATAAAGATGACACACAACAAATTCTTAAGGAGCATTCGCCAGATGAATTTATAAAAGATG<br>121 AACAAAATAAGGGACTAATTGATGAAATTACAAAGAAAAATATTCAACTAAAGAAGGAGA<br>181 TCCAAAAGCTTGAAACGGAGTTACAAGAGGCTACCAAAGAATTCCAGATTAAAGAGGATA<br>241 TTCCTGAAACAAAGATGAAATTCTTATCAGTTGAAACTCCTGAGAATGACAGCCAGTTGT<br>301 CAAATATCTCCTGTTCATTTCAAGTGAGCTCGAAAGTTCCTTATGAGATACAAAAAGGAC<br>361 AAGCACTTATCACCTTTGAAAAGAAGAAGTTGCTCAAAATGTGGTAAGCATGAGTAAAC<br>421 ATCATGTACAGATAAAAGATGTAAATCTGGAGGTTACGGCCAAGCCAGTTCCATTAAATT<br>481 CAGGAGTCAGATTCCAGGTTTATGTAGAAGTTTCTAAAATGAAAATCAATGTTACTGAAA<br>541 TTCCTGACACATTGCGTGAAGATCAAATGAGAGACAAGCTAGAACTGAGCTTTTGTAAGT<br>601 CCCGACACGGAGGAGGAGAGGTGGAATGCGTGAAGTACGATAAGCGGTCTGGAAGTGCTG<br>661 TCATCACGTTTGTGGAAACTGGAGTTGCTGACGAGATTTTGAAGAAGAAAGACTATCCTC<br>721 TTTATACAGATCATAGCTGCCATAGAGTTACTGTTTCTCCGTACATAGAAAAACACTTGA<br>781 AAAAGTTTCAGGTATTTTCAGGAATATCTAAGAGGACAGTGCTTCTGACTGGAATGGAAG<br>841 GCCTTGATATGATGGATGAAGAAACTGTGGAGGATTTAGTTAGCATTCACTTTCAACGGG<br>901 AGAAGAATGGAGGTGGTGAAGTCGATGTGGTCAAATGTTCTCTAGGTCAACCTTACATAG<br>961 CATACTTTGAAGAATACACTTAACAGAATCATGAAAACTATAGCTTTTTAACCCGGATTA<br>1021 CTGTAAATGTTTGACAAAAATGAGTATCCTTTTCCTTAAAAAAATGAAAACTTTAATTCT<br>1081 TTACTATCATTTATTTTTAGATACAAAATATGTTTCCACGTTTTTGAATTCTTCTTTCTT<br>1141 TCAAACTGTGCTGCATGTTCACAAATGCAATAAGTGCACTGAATTAAAAAGTTTTGTTTA<br>1201 TAGAAAAAAAAAAAAAAAAAAAAAAA | SEQ ID NO: 49 |
| | | 1 M E A D K D D T Q Q I L K E H S P D E F<br>1 ATGGAAGCTGATAAAGATGACACACAACAAATTCTTAAGGAGCATTCGCCAGATGAATTT<br>21 I K D E Q N K G L I D E I T K K N I Q L<br>61 ATAAAGATGAACAAAATAAGGGACTAATTGATGAAATTACAAAGAAAAATATTCAACTA<br>41 K K E I Q K L E T E L Q E A T K E F Q I<br>121 AAGAAGGAGATCCAAAAGCTTGAAACGGAGTTACAAGAGGCTACCAAAGAATTCCAGATT<br>61 K E D I P E T K M K F L S V E T P E N D<br>181 AAAGAGGATATTCCTGAAACAAAGATGAAATTCTTATCAGTTGAAACTCCTGAGAATGAC<br>81 S Q L S N I S C S F Q V S S K V P Y E I<br>241 AGCCAGTTGTCAAATATCTCCTGTTCATTTCAAGTGAGCTCGAAAGTTCCTTATGAGATA<br>101 Q K G Q A L I T F E K E E V A Q N V V S<br>301 CAAAAAGGACAAGCACTTATCACCTTTGAAAAGAAGAAGTTGCTCAAAATGTGGTAAGC<br>121 M S K H H V Q I K D V N L E V T A K P V<br>361 ATGAGTAAACATCATGTACAGATAAAAGATGTAAATCTGGAGGTTACGGCCAAGCCAGTT<br>141 P L N S G V R F Q V Y V E V S K M K I N<br>421 CCATTAAATTCAGGACTCAGATTCCAGGTTTATGTAGAAGTTTCTAAAATGAAAATCAAT<br>161 V T E I P D T L R E D Q M R D K L E L S<br>481 GTTACTGAAATTCCTGACACATTGCGTGAAGATCAAATGAGAGACAAGCTAGAACTGAGC<br>181 F C K S R H G G G E V E C V K Y D K R S<br>541 TTTTGTAAGTCCCGACACGGAGGAGGAGAGGTGGAATGCGTGAAGTACGATAAGCGGTCT<br>201 G S A V I T F V E T S V A D E I L K K K<br>601 GGAAGTGCTGTCATCACGTTTGTGGAAACTGGAGTTGCTGACGAGATTTTGAAGAAGAAA<br>221 D Y P L Y T D H S C H R V T V S P Y I E<br>661 GACTATCCTCTTTATACAGATCATAGCTGCCATAGAGTTACTGTTTCTCCGTACATAGAA<br>241 K H L K K F Q V F S G I S K R T V L L T<br>721 AAACACTTGAAAAAGTTTCAGGTATTTTCAGGAATATCTAAGAGGACAGTGCTTCTGACT<br>261 G M E G L D M M D E E T V E D L V S I H<br>781 GGAATGGAAGGCCTTGATATGATGGATGAAGAAACTGTGGAGGATTTAGTTAGCATTCAC<br>281 F Q R E K N G G G E V D V V K C S L S Q<br>841 TTTCAACGGGAGAAGAATGGAGGTGGTGAAGTCGATGTGGTCAAATGTTCTCTAGGTCAA<br>301 P Y I A Y F E E -<br>901 CCTTACATAGCATACTTTGAAGAATAG | SEQ ID NO: 50 |

TABLE 1-continued

| Gene | GenBank Homology | DNA SEQUENCE/DEDUCED AMINO ACID SEQUENCE | SEQUENCE IDENTIFIER: |
|---|---|---|---|
| WBC013G08_V1.3_AT | Homo sapiens cDNA FLJ16386 fis, clone TRACH2000862, moderately similar to Mus musculus putative purine nucleotide binding protein mRNA | 1 AGAACTCACATCGGATGATTCAGGCATGGCTCTGCTAACACTTTATTAAAAGCATGGATT<br>61 AATTTTACTTCCAAGTTTTATTTTTACTGCACCGTCCCATTTGTGGAAACAACTAGCTAC<br>121 TCAGCTTTTTTTTCCTTTTATAAAGGAAAGAACAGAAAAGTAAAAGGAGGAAAGAAAACA<br>181 AGAGGTGAGTGAGGCAACTGAAAACTGTTCTTGGACCTGCGGTGCTATAGAGCAGGCTCT<br>241 TCTAGGTTGGCAGTTGCCATGGAATCTGGACCCAAAATGTTGGCCCCCGTTTGCCTGGTG<br>301 GAAAATAACAATGAGCAGCTATTGGTGAACCAGCAAGCTATACAGATTCTTGAAAAGATT<br>361 TCTCAGCCAGTGGTGGTGGTGGCCATTGTAGGACTGTACCGTACAGGGAAATCCTACTTG<br>421 ATGAACCATCTGGCAGGACAGAATCATGGCTTCCCTCTGGGCTCCACGGTGCAGTCTGAA<br>481 ACCAAGGGCATCTGGATGTGGTGCGTGCCCCACCCATCCAAGCCAAACCACACCCTGGTC<br>541 CTTCTGGACACCGAAGGTCTGGGCGATGTGGAAAAGGGTGACCCTAAGAATGACTCCTGG<br>601 ATCTTTGCCCTGGCTGTGCTCCTGTGCAGCACCTTTGTCTACAACAGCATGAGCACCATC<br>661 AACCACCAGGCCCTGGAGCAGCTGCATTATGTGACAGAGCTTCACAGAGCTCATCAGGGCA<br>721 AAGTCTTCCCCAAGACCTGATGAAGTACAAGATTCCACAGAGTTTGTGAGTTTCTTTCCA<br>781 GACTTTATCTGGACTGTACGGGATTTCACCCTGGAGCTGAAGTTAGACGGTCACCCTATC<br>841 ACAGAAGATGAGTACTTGGAGAATGCCTTGAAGCTGATTCCAGGCAAGAATCCCAAAGTC<br>901 CAAGCGTCCAATCTACCCAGAGAGTGCATCAGGCTATTCTTTCCAAAACGGAAATGTTTT<br>961 GTATTTGACCGGCCAATAAACGACAAAGCACTCCTAGCTGACATTGAGAATGTGTCTGAA<br>1021 AACGAACTGGATTCTAAATTCCAAGAACAAATAAACAAGTTCTGTTCTCACATCTTCACC<br>1081 CATGCAAGACCTAAGACTCTTAGAGAGGGAATCATGGTCACTGGGAATCGGCTGAGGACT<br>1141 CTGGTGGTGACCTATGTGGATACCATCAATACTGGAGCAGTGCCTTGTTTGGAGAATGCA<br>1201 GTGAGAACTCTGGCCCAACTTGAGAACTCAGTGGCCATGCAGAAGGCAGCGGACCATTAC<br>1261 AGTGAGCAGATGGCCGAGAAATTGAAGTTGCCCACAGACACACTCCAGGAGCTGCTGGAC<br>1321 GTGCACACAGCCTGTGAGAGAGGCCATTGCATTTTTCATGGAGCACTCCTTCAAGGAT<br>1381 GAAAATCAGGAATTCCAGAAGAAGTTCATGGAAACCACAATGATAAGAAGGGGGATTTC<br>1441 TTGCTGCAGAATGAAGAGTCATCTGTTCAATACTGCCAGGCTAAACTCAATGAGCTCTCA<br>1501 AAGGGACTAATGGAAAGTATCTCAGCAGGAAGTTTCTCTGTTCCTGGAGGGCACAAGCTC<br>1561 TACATGGAAACAAAGGAAAGGATTGAACAGGACTATTGGCAAGTTCCCAGGAAAGGAGTA<br>1621 AAGGCAAAAGAGGTCTTCCAGAGGTTCCTGGAGTCACAGATGGTGATAGAGGAATCCATC<br>1681 TTGCAGTCAGATAAAGCCCTCACTGATAGAGAGAAGGCAGTAGCAGTGGATCGGGCAAG<br>1741 AAGGAGGCAGCTGAGAAGGAACAGGAACTTTTAAAACAGAAATTACAGGAGCAGCAGCAA<br>1801 CAGATGGAGGCTCAAGATAAGAGTCGCAAGGAAAACATAGCCCAACTGAAGGAGAAGCTG<br>1861 CAGATGGAGAGAGAACACCTACTGAGAGAGACAGATTATGATGTTGAGACACACGCAGAAG<br>1921 GTCCAAAATGATTGGCTTCATGAAGGATTTAAGAAGAAGTATGAGGAGATGAATGCAGAG<br>1981 ATAAGTCAATTTAAACGTATGATTGATACTACAAAAAATGATGATACTCCCTGGATTGCA<br>2041 CGAACCTTGGACAACCTTGCCGATGAGCTAACTGCAATATTGTCTGCTCCTGCTAAATTA<br>2101 ATTGGTCATGGTGTCAAAGGTGAGCTCACTCTTTAAAAAGCATAAGCTCCCCTTTTAA<br>2161 GGATATTATAGATTGTACATATATGCTTTGGACTATTTTTGATCTGTATGTTTTTCATTT<br>2221 TCATTCAGCAAGTTTTTTTTTTTCAGAGTCTTACTCTGTTGCCCAGGCTGGAGTACAG<br>2281 TGGTGCAATCTCAGCTCACTGCAACCTCTGCCTCCTGGGTTCAAGAGATTCACCTGCCTC<br>2341 AGCCCCCTAGTAGCTGGGATTATAGGTGTACACCACCACACCCAGCTAATTTTTGTATTT<br>2401 TTAGTAGAGATGGGGTTTCACTATGTTGGCCAGGCTGGTCTCGAACTCTTGACCTCAAAT<br>2461 GATCCACCCGCCTCGGCCTCCCAAAGTGCTGGGTTTACAGGCATGAGCCACCATGCCCAG<br>2521 CCCTCATTTAGCAAAGTTTTAAACATGAAAAGTGCTTATTAGAGGATATCAGTGCCTGGC<br>2581 CCACATGAGAGAACAGATCCATACACACTTTGAAAAACTTTGTTCACTTTTAGGAAATAT<br>2641 AATTTTGAAAAATCATTTACATACAAGAGGTCCACTGAGGCATTGCTTTTAATGGCAAAA<br>2701 TATTGCAATGTACTTGAATGTCCTTCACATTAGATTGGTAAGATAAATTTTAGTATGTGC<br>2761 ATGTACTGGAATATTATATAGCCAGTAAACAAATTGACAATGAAGCTCTATTTGTACCAG<br>2821 TAAAGAATGGTCTTGAAGACATTGTAAAATGA | SEQ ID NO: 51 |
| | | 1 M E S G P K M L A P V C L V E N N N E Q<br>1 ATGGAATCTGGACCCAAAATGTTGGCCCCCGTTTGCCTGGTGGAAAATAACAATGAGCAG<br>21 L L V N Q Q A I Q I L E K I S Q P V V V<br>61 CTATTGGTGAACCAGCAAGCTATACAGATTCTTGAAAAGATTTCTCAGCCAGTGGTGGTG<br>41 V A I V G L Y R T G K S Y L M N H L A G<br>121 GTGGCCATTGTAGGACTGTACCGTACAGGGAAATCCTACTTGATGAACCATCTGGCAGGA<br>61 Q N H G F P L G S T V Q S E T K G I W M<br>181 CAGAATCATGGCTTCCCTCTGGGCTCCACGGTGCAGTCTGAAACCAAGGGCATCTGGATG<br>81 W C V P H P S K P N H T L V L L D T E G<br>241 TGGTGCGTGCCCCACCCATCCAAGCCAAACCACACCCTGGTCCTTCTGGACACCGAAGGT<br>101 L G D V E K G D P K N D S W I F A L A V<br>301 CTGGGCGATGTGGAAAAGGGTGACCCTAAGAATGACTCCTGGATCTTTGCCCTGGCTGTG<br>121 L L C S T F V Y N S M S T I N H Q A L E<br>361 CTCCTGTGCAGCACCTTTGTCTACAACAGCATGAGCACCATCAACCACCAGGCCCTGGAG<br>141 Q L H Y V T E L T E L I R A K S S P R P<br>421 CAGCTGCATTATGTGACAGAGCTTCACAGAGCTCATCAGGGCAAAGTCTTCCCCAAGACCT<br>161 D E V Q D S T E F V S F F F D F I W T V<br>481 GATGAAGTACAAGATTCCACAGAGTTTGTGAGTTTCTTTCCAGACTTTATCTGGACTGTA<br>181 R D F T L E L K L D G H P I T E D E Y L<br>541 CGGGATTTCACCCTGGAGCTGAAGTTAGACGGTCACCCTATCACAGAAGATGAGTACTTG<br>201 E N A L K L I P G K N P K V Q A S N L P<br>601 GAGAATGCCTTGAAGCTGATTCCAGGCAAGAATCCCAAAGTCCAAGCGTCCAATCTACCC<br>221 R E C I R L F F P K R K C F V F D K P I<br>661 AGAGAGTGCATCAGGCTATTCTTTCCAAAACGGAAATGTTTTGTATTTGACCGGCCAATA | SEQ ID NO: 52 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 241 N D K A L L A D I E N V S E N E L D S K<br>721 AACGACAAAGCACTCCTAGCTGACATTGAGAATGTGTCTGAAAACGAACTGGATTCTAAA<br>261 F Q E Q I N K F C S H I F T H A R P K T<br>781 TTCCAAGAACAAATAAAGTTCTGTTCTCACATCTTCACCCATGCAAGACCTAAGACT<br>281 L R E G I M V T G N R L R T L V V T Y V<br>841 CTTAGAGAGGGAATCATGGTCACTGGGAATCGGCTGAGGACTCTGGTGGTGACCTATGTG<br>301 D T I N T G A V P C L E N A V R T L A Q<br>901 GATACCATCAATACTGGAGCAGTGCCTTGTTTGGAGAATGCAGTGAGAACTCTGGCCCAA<br>321 L E N S V A M Q K A A D H Y S E Q M A E<br>961 CTTGAGAACTCAGTGGCCATGCAGAAGGCAGCGGACCATTACAGTGAGCAGATGGCCGAG<br>341 K L K L P T D T L Q E L L D V H T A C E<br>1021 AAATTGAAGTTGCCCACAGACACACTCCAGGAGCTGCTGGACGTGCACACAGCCTGTGAG<br>361 R E A I A F F M E H S F K D E N Q E F Q<br>1081 AGAGAGGCCATTGCATTTTTCATGGAGCACTCCTTCAAGGATGAAAATCAGGAATTCCAG<br>381 K K F M E T T M N K K G D F L L Q N E E<br>1141 AAGAAGTTCATGGAAACCACAATGAATAAGAAGGGGGATTTCTTGCTGCAGAATGAAGAG<br>401 S S V Q Y C Q A K L N E L S K G L M E S<br>1201 TCATCTGTTCAATACTGCCAGGCTAAACTCAATGAGCTCTCAAAGGGACTAATGGAAAGT<br>421 I S A G S F S V P G G H K L Y M E T K E<br>1261 ATCTCAGCAGGAAGTTTCTCTGTTCCTGGAGGGCACAAGCTCTACATGGAAACAAAGGAA<br>441 R I E Q D Y W Q V P R K G V K A K E V F<br>1321 AGGATTGAACAGGACTATTGGCAAGTTCCCAGGAAAGGAGTAAAGGCAAAAGAGGTCTTC<br>461 Q R F L E S Q M V I E E S I L Q S D K A<br>1381 CAGAGGTTCCTGGAGTCACAGATGGTGATAGAGGAATCCATCTTGCAGTCAGATAAAGCC<br>481 L T D R E K A V A V D R A K K H E A E K<br>1441 CTCACTGATAGAGAGAAGGCAGTAGCAGTGGATCGGGCCAAGAAGGAGGCAGCTGAGAAG<br>501 E Q E L L K Q K L E Q Q Q Q M E A Q D<br>1501 GAACAGGAACTTTTAAAACAGAAATTACAGGAGCAGCAGCAACAGATGGAGGCTCAAGAT<br>521 K S R K E N I A Q L K E K L Q M E R E H<br>1561 AAGAGTCGCAAGGAAAAACATAGCCCAACTGAAGGAGAAGCTGCAGATGGAGAGAGAACAC<br>541 L L R E Q I M M L E H T Q K V Q N D W L<br>1621 CTACTGAGAGAGCAGATTATGATGTTGGAGCACACGCAGAAGGTCCAAAATGATTGGCTT<br>561 H E G F K K K Y E E M N A E I S Q F K R<br>1681 CATGAAGGATTTAAGAAGAAGTATGAGGAGATGAATGCAGAGATAAGTCAATTTAAACGT<br>581 M I D T T K N D D T P W I A R T L D N L<br>1741 ATGATTGACACTACAAAAAATGATGATACTCCCTGGATTGCACGAACCTTGGACAACCTT<br>601 A D E L T A I L S A P A K L I G H G V K<br>1801 GCCGATGAGCTAACTGCAATATTGTCTGCTCCTGCTAAATTAATTGGTCATGGTGTCAAA<br>621 G V S S L F K K H K L P F -<br>1861 GGTGTGAGCTCACFCTTTAAAAAGCATAAGCTCCCCTTTTAA | |
| BM735096 | *Homo sapiens* CD79A antigen (immunoglobulin-associated alpha) (CD79A), transcript variant 1 | 1 ATGCCTGGGGGTCCAGGAGTCCTCCAAGCTCTGCCTGCCACCATCTTCCTCCTCTTCCTG<br>61 CTGTCTGCTGTCTACCTGGGCCCTGGGTGCCAGGCCCTGTGGATGCACAAGGTCCCAGCA<br>121 TCATTGATGGTGAGCCTGGGGGAAGACGCCCACTTCCAATGCCCGCACAATAGCAGCAAC<br>181 AACGCCAACGTCACCTGGTGGCGCGTCCTCCATGGCAACTACACGTGGCCCCCTGAGTTC<br>241 TTGGGCCCGGGCGAGGACCCCAATGAGCCGCTCCCCAGACCCTTCCTGGACATGGGGGAG<br>301 GGCACCAAGAACAACATCATCACAGCCGAGGGATCATCCTGCTGTTCTGCGCAGTGGTG<br>361 CCTGGGACGCTGCTGCTGTTCAGGAAACGATGGCAGAACTTGAAGTTCGGGCCAGACATC<br>421 CAGGATGACTACGAAGATGAGAATCTTTATGAGGGCCTGAACCTCGATGACTGTTCCATG<br>481 TACGAGGACATCTCCCGGGGCCTCCAGGGCACCTACCAGGACGTGGGCAGCCTCCACATC<br>541 GGAGACGTCCAGCTGGAGAAGCCGTGA | SEQ ID NO: 53 |
| | | 1 M P G G P G V L Q A L P A T I F L L F L<br>1 ATGCCTGGGGGTCCAGGAGTCCTCCAAGCTCTGCCTGCCACCATCTTCCTCCTCTTCCTG<br>21 L S A V Y L G P G C Q A L W M H K V P A<br>61 CTGTCTGCTGTCTACCTGGGCCCTGGGTGCCAGGCCCTGTGGATGCACAAGGTCCCAGCA<br>41 S L M V S L G E D A H F Q C P H N S S N<br>121 TCATTGATGGTGAGCCTGGGGGAAGACGCCCACTTCCAATGCCCGCACAATAGCAGCAAC<br>61 N A N V T W W R V L H G N Y T W P P E F<br>181 AACGCCAACGTCACCTGGTGGCGCGTCCTCCATGGCAACTACACGTGGCCCCCTGAGTTC<br>81 L G P G E D P N E P L P R P F L D M G E<br>241 TTGGGCCCGGGCGAGGACCCCAATGAGCCGCTCCCCAGACCCTTCCTGGACATGGGGGAG<br>101 G T K N N I I T A E G I I L L F C A V V<br>301 GGCACCAAGAACAACATCATCACAGCCGAGGGATCATCCTGCTGTTCTGCGCAGTGGTG<br>121 P G T L L L F R K R W Q N L K F G P D I<br>361 CCTGGGACGCTGCTGCTGTTCAGGAAACGATGGCAGAACTTGAAGTTCGGGCCAGACATC<br>141 Q D D Y E D E N L Y E G L N L D D C S M<br>421 CAGGATGACTACGAAGATGAGAATCTTTATGAGGGCCTGAACCTCGATGACTGTTCCATG<br>161 Y E D I S R G L Q G T Y Q D V G S L H I<br>481 TACGAGGACATCTCCCGGGGCCTCCAGGGCACCTACCAGGACGTGGGCAGCCTCCACATC<br>181 G D V Q L E K P -<br>541 GGAGACGTCCAGCTGGAGAAGCCGTGA | SEQ ID NO: 54 |

TABLE 1-continued

| Gene | GenBank Homology | DNA SEQUENCE/DEDUCED AMINO ACID SEQUENCE | SEQUENCE IDENTIFIER: |
|---|---|---|---|
| GI1305528.V1.3_AT | *Equus caballus* Mx protein homolog mRNA. | 1 GGCACGAGTGGAGAACAGCTCTGCATTTCTGTCCAAGCAGTCAGCGGTCCATCGTCAAGT<br>61 AAAGGAAGCTATATTGGAGATAACTGAACCGATAAAGGAAGAAGATGGTTCATTCTGAAG<br>121 CGAAAATGACAAGACCTGATTCAGCTTCCGCATCCAAGCAACAATTACTAAATGGAAATG<br>181 CTGACATACAGGAGACAAATCAGAAAAGAAGCATTGAGAAAAACCTGTGTAGCCAGTATG<br>241 AGGAGAAGGTACGCCCATGCATTGATCTCATCGACTCCCTGCGGGCTCTGGGTGTGGAGC<br>301 AGGACCTGGCCCTGCCTGCCATCGCCGTCATCGGGGACCAGAGCTCGGGCAAGAGCTCTG<br>361 TGCTGGAAGCTCTTTCAGGGGTCGCCCTTCCCAGAAACAGTGGTATTGTGACAAGATGTC<br>421 CTCTGGTCTGAAACTGAAAAGACTGGTGAAAGAAGATGAGTGGAAAAGGCAAAGTCAGCT<br>481 ACCGGGATATCGAGGTTGAGATTTCAAATGCTTTGGATGTGGAAGAGCAAGTCAGAAAAG<br>541 CCCAGAATGTCCTTGCTGGGGAAGGAGTGGGAATCAGTCAGGAGCTAGTCACTCTGGAAG<br>601 TCAGCTCTCCTCATGTCCCGGATCTGACCCTTGATCGACCTTCCTGGCATCACCAGGGTGG<br>661 CCGTGGGCAATCAGCCAGCCGACATCGGACGTCAGATCAAGACACTCATCAGGAAGTACA<br>721 TCCAGAGGCAAGAGACGATCAACCTGGTGGTGGTCCCCAGTAACGTGGACATCGCCACCA<br>781 CGGAGGCGCTGAGCATGGCTCAGGAGGTGGACCCCGAGGGAGACAGGACCATAGGAATCT<br>841 TGACAAAGCCTGACCTGGTGGACAAAGGCACCGAGGAGCAGGTGGTAGACGTGGTGCGAA<br>901 ACCTCATCTGCCACCTGAAGAAGGGTTATATGATCGTCAAGTGCCGGGGCCAGCAGGACA<br>961 TCCAGGACCGACTGAGCCTGGCTGAGGCTCTGCAGAGAGAGAAGGCCTTCTTTGAGGAAA<br>1021 ACCCATATTTCAGGGGCCTTCTGGAGGAAGGAAGAGCCTCGGTCCCCTGCCTGGCGGAGA<br>1081 GGCTGACCACTGAACTCATCACGCACATCAGTAAATCTCTGCCCCTGTTAGAAAATCAAA<br>1141 TAAAGGAAGTTACCAGAATCTATCAGACGAGTTACAAAAAATATGGCACCGACATCCCAG<br>1201 AAGATGAAACTGAAAAACGTTCTTCCTGATAGTGAAATTACTACATTTAATCAGAACA<br>1261 TCACCTCTTTCGTACAAGGGGAGGAACTTGTAGGACCCAATGACACTCGGCTGTTTAACA<br>1321 AAATCCGACAGGAGTTCCAGAAATTGGAGTGGGGTGATTGAAAACAATTTCCGAAAAGGTG<br>1381 GCGAAGCTATCCGTAGACAGATCTGGACATTTGAAAAACAGTATCGTGCAGAGAGCTAC<br>1441 CAGGATTTGTGAATTACAGGACATTTGAGACGATCATCAAACAGCAAATCCAGTTGCTGG<br>1501 AAGAGCCAGCCATTGATATGCTGCACAGGATAAGTGATCTGGTCCGGGATACCTTCACAA<br>1561 AAGTTTCAGAAAAAAATTTCAGTGAATTTTTCAACCTCCACAGAACCACCAAGTCCAAAC<br>1621 TTGAAGACATTAAATTAGAACAAGAAATGAAGCTGAGAAGTCGATCCGACTCCACTTCC<br>1681 AAATGGAGAAGATCGTCTACTGCCAAGACCACGTTTACCGGGGCACGTTACAGAAGGTCA<br>1741 GAGAGAATGAAATGGAGGAGGAGAAGAAGAAAAAAACAATCAACGTCTGGGGTCAAAACA<br>1801 CTTCCACAGAGTCCTCGATGCAGAAATCTTGGAGCATCTCAACGCCTACCAGCACGAGG<br>1861 CCGGCAACCGCCTCTCGACCCACATCCCCTTGATCATCCAGTTCTTCGTCCTCCAGACAT<br>1921 TCGGCCAGCAGCTGCAGAAGTCCATGCTGCAGCCTCCTGCAGGACAGGGACACCTACGACT<br>1981 GGCTCCTGAAGGAGCGCAACGACACCTGTGACAAGAGGAAGTTCCTGAAGGAGCGGCTTG<br>2041 CTCGGCTGGCCCAGGCTCGGCGCCGGTTAGCCAAGTTCCCGGGTTAAATCGGGCTCTCTG<br>2101 TCTCAGCCTCATGTCTCCATGCAGCATCTCCAGGGAGCGGAGGCCCAGCATCTCTCCCCAA<br>2161 CAGCCACACCATCATTAGTTACCCATTCACAGATACCCGAGCGGTTACGGGTCAGGCTTG<br>2221 GTGGTCACTGTCTGTGCTTGTCCTTTAGTGGATAAGGATGCGCTAAGAACCTGTGATGAG<br>2281 CGATTTGGTTTCAAGCATTGAGACTAGAGCCCCGCCTTCATGTAGCATATGCTTTAGACT<br>2341 GAATGAGCAGTGCCATTTTCTGGTTAGGAGAAATGGTTTTCTACCCCCAGGATTGGTCCT<br>2401 CGTCTCCAGACTCTCTCCATCTCTTTATCAGAGACCGATGTACGTGCAGCATCATGGAAC<br>2461 GGTTATTTTCGTTTTTTTGTGTTGTCCTTTCGCATACCCAGTGTTTTAGGCGTGTGAGT<br>2521 GCTGCTTGTGTGAATGCTTGTAGATGCCATGTTTCATCTATTTGTAATAAACTTTTTTCT<br>2581 ACTAGAAAAAAAAAAAAAAAAAAAAAAA | SEQ ID NO: 55 |
| | | 1 M V H S E A K M T R P D S A S A S K Q Q<br>1 ATGGTTCATTCTGAAGCGAAAATGACAAGACCTGATTCAGCTTCCGCATCCAAGCAACAA<br>21 L L N G N A D I Q E T N Q K R S I E K N<br>61 TTACTAAATGGAAATGCTGACATACAGGAGACAAATCAGAAAAGAAGCATTGAGAAAAAC<br>41 L C S Q Y E E K V R P C I D L I D S L R<br>121 CTGTGTAGCCAGTATGAGGAGAAGGTACGCCCATGCATTGATCTCATCGACTCCCTGCGG<br>61 A L G V E Q D L A L P A I A V I G D Q S<br>181 GCTCTGGGTGTGGAGCAGGACCKGGCCCTGCCTGCCATCGCCGTCATCGGGGACCAGAGC<br>81 S G K S S V L E A L S G V A L P R G S G<br>241 TCGGGCAAGAGCTCTGTGCTGGAAGCTCTTTCAGGGGTCGCCCTTCCCAGAGGCAGTGGT<br>101 I V T R C P L V L K L K R L V K E D E W<br>301 ATTGTGACAAGATGTCCTCTGGTGCTGAAACTGAAAGACTGGTGAAAGAAGATGAGTGG<br>121 K G K V S Y R D I E V E I S N A L D V E<br>361 AAAGGCAAAGTCAGCTACCGGGATATCGAGGTTGAGATTTCAAATGCTTTGGATGTGGAA<br>141 E Q V R K A Q N V L A G K G V G I S Q E<br>421 GAGCAAGTCAGAAAAGCCCAGAATGTCCTTGCTGGGGAAGGAGTGGGAATCAGTCAGGAG<br>161 L V T L E V S S P H V P D L T L I D L P<br>481 CTAGTCACTCTGGAAGTCAGCTCTCCTCATGTCCCGGATCTGACCCTGATCGACCTTCCT<br>181 G I T R V A V G N Q P A D I G R Q I K T<br>541 GGCATCACCAGGGTGGCCGTGGGCAATCAGCCAGCCGACATCGGACGTCAGATCAAGACA<br>201 L I R K Y I Q R Q E T I N L V V V P S N<br>601 CTCATCAGGAAGTACATCCAGAGGCAAGAGACGATCAACCTGGTGGTGGTCCCCAGTAAC<br>221 V D I A T T E A L S M A Q E V D P E G D<br>661 GTGGACATCGCCACCACGGAGGCGCTGAGCATGGCTCAGGAGGTGGACCCCGAGGGAGAC<br>241 R T I G I L T K P D L V D K G T E E Q V<br>721 AGGACCATAGGAATCTTGACAAAGCCTGACCTGGTGGACAAAGGCACCGAGGAGCAGGTG<br>261 V D V V R N L I C H L K K G Y M I V K C<br>781 GTAGACGTGGTGCGAAACCTCATCTGCCACCTGAAGAAGGGTTATATGATCGTCAAGTGC | SEQ ID NO: 56 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 281 K G Q Q D I Q D R L S L A E A L Q R E K<br>841 CGGGGCCAGCAGGACATCCAGGACCGACTGAGCCTGGCTGAGGCTCTGCAGAGAGAGAAG<br>301 A F F E E N P Y F R G L L E E G R A S V<br>901 GCCTTCTTTGAGGAAAACCCATATTTCAGGGGCCTTCTGGAGGAAGGAAGAGCCTCGGTC<br>321 P C L A E R L T T E L I T H I S K S L P<br>961 CCCTGCCTGGCGGAGAGGCTGACCACTGAACTCATCACGCACATCAGTAAATCTCTGCCC<br>341 L L E N Q I K E S Y Q N L S D E L Q K Y<br>1021 CTGTTAGAAAATCAAAKAAGGAAAGTTACCAGAATCTATCAGACGAGTTACAAAAATAT<br>361 G T D I P E D E T E K T F F L I V K I T<br>1081 GGCACCGACATCCCAGAAGATGAAACTGAAAAAACGTTCTTCCTGATAGTGAAAATTACT<br>381 T F N Q N I T S F V Q G E E L V G P N D<br>1141 ACATTTAATCAGAACATCACCTCTTTCGTACAAGGGGAGGAACTTGTAGGACCCAATGAC<br>401 T R L F N K I R Q E F Q K W S G V I E N<br>1201 ACTCGGCTGTTTAACAAAATCCGACAGGAGTTCCAGAAATGGAGTGGGGTGATTGAAAAC<br>421 N F R K G G E A I R R Q I W T F E N Q Y<br>1261 AATTTCCGAAAAGGTGGCGAAGCTATCCGTAGACAGATCTGGACATTTGAAAATCAGTAT<br>441 R G R E L P G F V N Y R T F E T I I K Q<br>1321 CGTGGCAGAGAGCTACCAGGATTTGTGAATTACAGGACATTTGAGACGATCATCAAACAG<br>461 Q I Q L L E E P A I D M L H R I S D L V<br>1381 CAAATCCAGTTGCTGGAAGAGCCAGCCATTGATATGCTGCACAGGATAAGTGATCTGGTC<br>481 R D T F T K V S E K N F S E F F N L H R<br>1441 CGGGATACCTTCACAAAAGTTTCAGAAAAAAATTTCAGTGAATTTTTCAACCTCCACAGA<br>501 T T K S K L E D I K L E Q E N E A E K S<br>1501 ACCACCAAGTCCAAACTTGAAGACATTAAATTAGAACAAGAAAATGAAGCTGAGAAGTCG<br>521 I R L H F Q M E K I V Y C Q D H V Y R G<br>1561 ATCCGACTCCACTTCCAAATGGAGAAGATCGTCTACTGCCAAGACCACGTTTACCGGGGC<br>541 T L Q K V R E N E M E E E K K K K T I N<br>1621 ACGTTACAGAAGGTCAGAGAGAATGAAATGGAGGAGGAGAAGAAGAAAAAAACAATCAAC<br>561 V W G Q N T S T E S S M A E I L E H L N<br>1681 GTCTGGGGTCAAAACACTTCCACAGAGTCCTCGATGGCAGAAATCTTGGAGCATCTCAAC<br>581 A Y Q H E A G N R L S T H I P L I I Q F<br>1741 GCCTACCAGCACGAGGCCGGCAACCGCCTCTCGACCCACATCCCCTTGATCATCCAGTTC<br>601 F V L Q T F G Q Q L Q K S M L Q L L Q D<br>1801 TTCGTCCTCCAGACATTCGGCCAGCAGCTGCAGAAGTCCATGCTGCAGCTCCTGCAGGAC<br>621 R D T Y D W I L K E R N D T C D K R K F<br>1861 AGGGACACCTACGACTGGCTCCTGAAGGAGCGCAACGACACCTGTGACAAGAGGAAGTTC<br>641 L K E R L A R L A Q A R R R L A K F P G<br>1921 CTGAAGGAGCGGCTTGCTCGGCTGGCCCAGGCTCGGCGCCGGTTAGCCAAGTTCCCGGGT<br>661 -<br>1981 TAA | |
| WBC881.GRSP.V1.3_AT | Homo sapiens makorin, ring finger protein, 1, mRNA | 1 AGCGCTCAGATACGCGACGCGTAGCAGGCGGGGACCGAACGGGTGCCTCAGTGTCCTTCC<br>61 CCTCCCCTCGCCTGGCCTCGCCGTCCTCTCCCCGCAGCCGGACCGGAACTATGTGATCCC<br>121 GGAAGTTCCGGGGCCTTTGCTGTGTGGGATAAACAGTAATGGCGGAGGCTGCAACTCCCG<br>181 GAACAACAGCCACAACATCAGGACAGGAGCGGCAGCGGCGACGGCGGCAGCAGCCTCCC<br>241 CCACCCCGATCCCCACAGTCACCGCCCCGTCCCTGGGGCGGGCGGAGGGGGCGGCGGCA<br>301 GCGACGGCAGCGGCGGCGGCTGGACTAAACAGGTCACCTGCAGGTATTTTATGCATGGGG<br>361 TTTGTAAGGAAGGAGACAACTGTCGCTACTCGCATGACCTCTCTGACAGTCCGTATAGTG<br>421 TAGTGTGCAAGTATTTTCAGCGAGGGTACTGTATTTATGGAGACCGCTGCAGATATGAAC<br>481 ATAGCAAACCATTGAAACAGGAAGAAGCAACTGCTACAGAGCTAACTACAAAGTCATCCC<br>541 TTGCTGCTTCCTCAAGTCTCTCATCGATAGTTGGACCACTTGTTGAAATGAATACAGGCG<br>601 AAGCTGAGTCAAGAAATTCAAACTTTGCAACTGTAGGAGCAGGTTCAGAGGACTGGGTGA<br>661 ATGCTATTGAGTTTGTTCCTGGGCAACCCTACTGTGGCCGTACTGCGCCTTCCTGCACTG<br>721 AAGCACCCCTGCAGGGCTCAGTGACCAAGGAAGAATCAGAGAAAGAGCAAACCGCCGTGG<br>781 AGACAAAGAAGCAGCTGTGCCCCTATGCTGCAGTGGGAGAGTGCCGATACGGGGAGAACT<br>841 GTGTGTATCTCCACGGAGATTCTTGTGACATGTGTGGGCTGCAGCTCCTGCATCCAATGG<br>901 ATGCTGCCCAGAGATCGCAGCATATCAAATCGTGCATTGAGGCCCATGAAGAGGACATGG<br>961 AGCTCTCATTTGCCGTGCAGCGCAGCAAGGACATGGTGTGTGGGATCTGCATGGAGGTGG<br>1021 TCTATGAGAAAGCCAACCCCAGTGAGCGCCGCTTCGGGATCCTCTCCAACTGCAACCACA<br>1081 CCTACTGTCTCAAGTGCATTCGCAAGTGGAGGAGTGCTAAGCAATTTGAGAGCAAGATCA<br>1141 TAAAGTCCTGCCCAGAATGCCGGATCACATCTAACTTTGTCATTCCAAGTGAGTACTGGG<br>1201 TGGAGGAGAAAGAAGAAGCAGAAACTCATTCTGAAATACAAGGAGGCAATGAGCAACA<br>1261 AGGCGTGCAGGTATTTTGATGAAGGACGTGGGAGCTGCCCATTTGGAGGGAACTGTTTTT<br>1321 ACAAGCATGCGTACCCTGATGGCCGTAGAGAGGAGCCACAGAGACAGAAAGTGGGAACAT<br>1381 CAAGCAGATACCGGGCCCAACGAAGGAACCCACTTCTGGGAACTCATTGAGGAAAGAGAGA<br>1441 ACAGACAACCCCTTTGCAACGATGAAGAAGAGGTTGTCACCTTTGAGCTGGGCGAGATGT<br>1501 TGCTTATGCTTTTGGCTGCAGGTGGGGACGACGAACTAACAGACTCTGAAGATGAGTGGG<br>1561 ACTTGTTTCATGATGAGCTGGAAGATTTTTATGCTTGGATCTATAGCAACCTTGCGTGG<br>1621 CGTGTGAACTGGTCTGCTGACCTCCAGACAGCAGCTGTCCCCTGTGGTGGTGTGCAGTGC<br>1681 CTGTGTTCTCTCCTAGGCAGGCCTCTCAACTCCAGGTGCTGTCCTAAGAATTTTTACCCA<br>1741 GGGCCTGTCTTCTCAACCCCTCACCTTTCCCTGAGGAGTGTGTTGTTTTCCCTGTTGAAA<br>1801 AAAGTTACAAAAATAAATCTTAAAGTTAGTTTTTGTAACACGAATTTAACTGTCAGACA<br>1861 GTTAGTGTAGGTGTGTTGCGTCATCTGTTTTCAACCAGATTGCATTTATGGACTTTTCAC<br>1921 ACACTCATTTTGAGGACCCCAGGTTCAAAAGTAAAAGCAGTGGCCCTGCTTTGGGGTCCA | SEQ ID NO: 57 |

TABLE 1-continued

| Gene | GenBank Homology | DNA SEQUENCE/DEDUCED AMINO ACID SEQUENCE | SEQUENCE IDENTIFIER: |
|------|------------------|------------------------------------------|----------------------|
| | | 1981 AGAATAGGAGTGATGGGTGAAGGGACCTAAGCTGGCCAATAGCCCTCTGCCCCAGACATG<br>2041 GGATGTGGATCCTTGAGGTTTCTGGTGAAATCTGCACATCTGTGTTTTTATATCTGTTCC<br>2101 CTACCCTGTAATCCCTACCACGTGCACTTGTTCTGTGGTTTTGGTCTCTTGTTTAATTGC<br>2161 ACACAAGTAATACTACTGGGTAACCAGAATCAGGTGTGAATGTGTTGAGATTTTTTACTG<br>2221 TTTTGCATGATAGGAAAATTGAGAAAGAATACGTATAAAAGATAGAGAGGCATAACATCA<br>2281 ATGCAGAGTTGGAAGTTGGCTCCCAAGGGCTGACATGGTGTGAGTGTGTGGGTGTGTGAT<br>2341 AAGCTTCTCATCCCTGCATAGATGCAGTATTCTTAGCCTTAGTAGAAAAACCTGGTTTAG<br>2401 TGGTTTAAGCCTTGTGTGGCAGATAGATCTTAAAGGGCAAAGCAGTATATTGGTAGTTGT<br>2461 CAATATAGCAGTGCTAGCTCTGTCTATATAAATAGAGAAATGGGGTTAGCCATAGAGGTT<br>2521 AAAACTACCTGGTTATCCCATATAATAACACAAACTGGGTCTCGAATACACAGTTGTATT<br>2581 TAATGTTTTCTGATCCCCCAGCCGTCCCAGCCCACGCACTTTTTCACAAACGTTTGTCCT<br>2641 CGTTGAGGGTTTCGTTCTCGGGTTTTTGTGTTTGTTTTTGTGGGTATTGCCTCATTCCAT<br>2701 CCCTGAGGCTTTGCAGGTAGACAGATGTGATTCAGAACTATGTTCCAGGGTGTTCCTTGTA<br>2761 GGAGTAATTGGTTTGCAGTAAGAAGTCACACTTTTCCACTAAAGGGGAGGAGGTGGTAAT<br>2821 CTACGAGACAAGCTAAAGTTAAGTTGTTAGAAGAATTCCTTGATTGGAATTTTAGCTTTG<br>2881 CATTTTGTTGCTCTCTTTCCTGGAAATAATTCGGAGACGCTCCTGATTTGTCCATCTACT<br>2941 GCTTTGGTTCCTTGGATCCACCCATTCTTTCACTTTAAGAAAACAAGTAATTGTTGCAG<br>3001 AGGTCTCTGTATTTTGCAGCTGCCCTTTTGTAAGAAGCACTTTTCCCAAATAAAACAATG<br>3061 AAAAAAAAAAAAAAAAAAAAAAAAAAAAAAAAAAAAAAAAA | |
| | |    1 M  A  E  A  A  T  P  G  T  T  A  T  T  S  G  A  G  A  A  A<br>   1 ATGGCGGAGGCTGCAACTCCCGGAACAACAGCCCACAACATCAGGAGCAGGAGCGGCAGCG<br>  21 A  T  A  A  A  A  S  P  T  P  I  P  T  V  T  A  P  S  L  G<br>  61 GCGACGGCGGCAGCAGCCTCCCCCACCCCGATCCCCACAGTCACCGCCCCGTCCCTGGGG<br>  41 A  G  G  G  G  G  S  D  G  S  G  G  G  W  T  K  Q  V  T<br> 121 GCGGGCGGAGGGGGCGGCGGCAGCGACGGCAGCGGCGGCGGCTGGACTAAACAGGTCACC<br>  61 C  R  Y  F  M  H  G  V  C  K  E  G  D  N  C  R  Y  S  H  D<br> 181 TGCAGGTATTTTATGCATGGGGTTTGTAAGGAAGGAGACAACTGTCGCTACTCGCATGAC<br>  81 L  S  D  S  P  Y  S  V  V  C  K  V  F  Q  R  G  Y  C  I  Y<br> 241 CTCTCTGACAGTCCGTATAGTGTAGTGTGCAAGTATTTTCAGCGAGGGTACTGTATTTAT<br> 101 G  D  R  C  R  Y  E  H  S  K  P  L  K  Q  E  E  A  T  A  T<br> 301 GGAGACCGCTGCAGATATGAACATAGCAAACCATTGAAACAGGAAGAAGCAACTGCTACA<br> 121 E  L  T  T  K  S  S  L  A  A  S  S  S  L  S  S  I  V  G  P<br> 361 GAGCTAACTACAAAGTCATCCCTTGCTGCTTCCTCAAGTCTCTCATCGATAGTTGGACCA<br> 141 L  V  E  M  N  T  G  E  A  E  S  R  N  S  N  F  A  T  V  G<br> 421 CTTGTTGAAATGAATACAGGCGAAGCTGAGTCAAGAAATTCAAACTTTGCAACTGTAGGA<br> 161 A  G  S  E  D  W  V  N  A  I  E  F  V  P  G  Q  P  V  C  G<br> 481 GCAGGTTCAGAGGACTGGGTGAATGCTATTGAGTTTGTTCCTGGGCAACCCTACTGTGGC<br> 181 R  T  A  P  S  C  T  E  A  P  L  Q  G  S  V  T  K  E  E  S<br> 541 CGTACTGCGCCTTCCTGCACTGAAGCACCCCTGCAGGGCTCAGTGACCAAGGAAGAATCA<br> 201 E  K  E  Q  T  A  V  E  T  K  K  Q  L  C  P  Y  A  A  V  G<br> 601 GAGAAAGAGCAAACCGCCGTGGAGACAAAGAAGCAGCTGTGCCCCTATGCTGCAGTGGGA<br> 221 E  C  R  Y  G  E  N  C  V  Y  L  H  G  D  S  C  D  M  C  G<br> 661 GAGTGCCGATACGGGGAGAACTGTGTGTATCTCCACGGAGATTCTTGTGACATGTGTGGG<br> 241 L  Q  L  L  H  P  M  D  A  A  Q  R  S  Q  H  I  K  S  C  I<br> 721 CTGCAGCTCCTGCATCCAATGGATGCTGCCCAGAGATCGCAGCATATCAAATCGTCATT<br> 261 E  A  H  E  K  D  M  E  L  S  F  A  V  Q  R  S  K  D  M  V<br> 781 GAGGCCCATGAGAAGGACATGGAGCTCTCATTTGCCGTGCAGCGCAGCAAGGACATGGTG<br> 281 C  G  I  C  M  E  V  V  Y  E  K  A  N  P  S  E  R  R  F  G<br> 841 TGTGGGATCTGCATGGAGGTGGTCTATGAGAAGCCAACCCCAGTGAGCCCCGCTTCGGG<br> 301 I  L  S  N  C  N  H  T  Y  C  L  K  C  I  R  K  N  R  S  A<br> 901 ATCCTCTCCAACTGCAACCACACCTACTGTCTCAAGTGCATTCGCAAGTGGAGGAGTGCT<br> 321 K  Q  F  E  S  K  I  I  K  S  C  P  E  C  R  I  T  S  N  F<br> 961 AAGCAATTTGAGAGCAAGATCATAAAGTCCTGCCCAGAATGCCGGATCACATCTAACTTT<br> 341 V  I  P  S  E  Y  W  V  E  E  K  E  E  Q  K  L  I  L  K<br>1021 GTCATTCCAAGTGAGTACTGGGTGGAGGAGAAAGAAGAGAAGCAGAAACTCATTCTGAAA<br> 361 Y  K  E  A  M  S  N  K  A  C  R  Y  F  D  K  G  R  G  S  C<br>1081 TACAAGGAGGCAATGAGCAACAAGGCGTGCAGGTATTTTGATGAAGGACGTGGGAGCTGC<br> 381 P  F  G  G  N  C  F  Y  K  H  A  Y  P  D  G  R  R  E  E  P<br>1141 CCATTTGGAGGGAACTGTTTTTACAAGCATGCGTACCCTGATGGCCGTAGAGAGGAGCCA<br> 401 Q  R  Q  K  V  G  T  S  S  R  Y  R  A  Q  R  R  N  H  F  W<br>1201 CAGAGACAGAAAGTGGGAACATCAAGCAGATACCGCGCCCAACGAAGGAACCACTTCTGG<br> 421 E  L  I  E  E  R  E  N  S  N  P  F  D  N  D  E  E  V  V<br>1261 GAACTCATTGAGGAAAGAGAGAACAGCAACCCCTTTGACAACGATGAAGAAGAGGTTGTC<br> 441 T  F  E  L  G  E  M  L  L  M  L  L  A  A  G  G  D  E  L<br>1321 ACCTTTGAGCTGGGCGAGATGTTGCTTATGCTTTTGGCTGCAGGTGGGGACGACGAACTA<br> 461 T  D  S  E  D  E  W  D  L  F  H  D  E  L  E  D  F  Y  D  L<br>1381 ACAGACTCTGAAGATGAGTGGGACTTGTTTCATGATGAGCTGGAAGATTTTTATGACTTG<br> 481 D  L  -<br>1441 GATCTATAG | SEQ ID NO: 58 |

TABLE 1-continued

| Gene | GenBank Homology | DNA SEQUENCE/DEDUCED AMINO ACID SEQUENCE | SEQUENCE IDENTIFIER: |
|---|---|---|---|
| WBC44.V1.3_AT | *Homo sapiens* B aggressive lymphoma gene, mRNA. | 1 GAGCGGCCTGCCGGAAGTGGGCCACCATATCTGGAAACTACAGTCTATGCTTTGAAGCGC<br>61 AAAAGGGAATAAACATTTAAAGACTCCCCCGGGGACCTGGAGGATGGACTTTTCCATGGT<br>121 GGCCGGAGCAGCAGCTTACAATGAAAAATCAGAGACTGGTGCTCTTGGAGAAAACTATAG<br>181 TTGGCAAATTCCCATTAACCACAATGACTTCAAAATTTTAAAAAATAATGAGCGTCAGCT<br>241 GTGTGAAGTCCTCCAGAATAAGTTTGGCTGTATCTCTACCCTGGTCTCTCCAGTTCAGGA<br>301 AGGCAACAGCAAATCTCTGCAAGTGTTCAGAAAAATGCTGACTCCTAGGATAGAGTTATC<br>361 AGTCTGGAAAGATGACCTCACCACACATGCTGTTGATGCTGTGGTGAATGCAGCCAATGA<br>421 AGATCTTCTGCATGGGGGAGGCCTGCCCCTGGCCCTGGTAAAAGCTGGTGGATTTGAAAT<br>481 CCAAGAAGAGAGCAAACAGTTTGTTGCCAGATATGGTAAAGTGTCAGCTGGTGAGATAGC<br>541 TGTCACGGGAGCAGGGAGGCTTCCCTGCAAACAGATCATCCATGCTGTTGGGCCTCGGTG<br>601 GATGGAATGGGATAAACAGGGATGTACTGGAAAGCTGCAGAGGGCCATTGTAAGTATTCT<br>661 GAATTATGTCATCTATAAAAATACTCACATTAAGACAGTAGCAATTCCAGCCTTGAGCTC<br>721 TGGGATTTTTCAGTTCCCTCTGAATTTGTGTACAAAGACTATTGTAGAGACTATCCGGGT<br>781 TAGTTTGCAAGGGAAGCCAATGATGAGTAATTTGAAAGAAATTCACCTGGTGAGCAATGA<br>841 GGACCCTACTGTTGCTGCCTTTAAAGCTGCTTCAGAATTCATCCTAGGGAAGAGTGAGCT<br>901 GGGACAAGAAACCACCCCTTCTTTCAATGCAATGGTCGTGAACAACCTGACCCTCCAGAT<br>961 TGTCCAGGGCCACATTGAATGGCAGACGGCAGATGTAATTGTTAATTCTGTAAACCCACA<br>1021 TGATATTACAGTTGGACCTGTGGCAAAGTCAATTCTACAACAAGCAGGAGTTGAAATGAA<br>1081 ATCGGAATTCTTGCCACAAAGGCTAAACAGTTTCAACGGTCCCAGTTGGTACTGGTCAC<br>1141 AAAAGGATTTAACTTGTTCTGTAATATATATACCATGTACTGTGGCATAACAGAATTTCC<br>1201 TAAACCTCAGATATTAAAACATGCAATGAAGGAGTGTTTGGAAAAATGCATTGAGCAAAA<br>1261 TATAACTTCCATTTCCTTTCCTGCCCTTGGGACTGGAAACATGGAAATAAAGAAGGAAAC<br>1321 AGCAGCAGAGATTTTGTTTGATGAAGTTTTAACATTTGCCAAAGACCATGTAAAACACCA<br>1381 GTTAACTGTAAAATTTGTGATCTTTCCAACAGATTTGGAGATATATAAGGCTTTCAGTTC<br>1441 TGAAATGGCAAAGAGGTCCAAGATGCTGAGTTTGAACAATTACAGTGTCCCCCAGTCAAC<br>1501 CAGAGAGGAGAAAAGAGAAAATGGGCTTGAAGCTAGATCTCCTGCCATCAATCTGATGGG<br>1561 ATTCAACGTGGAAGAGATGThTGAGGCCCACGCATGGATCCAAAGAATCCTGAGTCTCCA<br>1621 GAACCACCACATCATTGAGAATAATCATATTCTGTACCTTGGGAGAAAGGAACATGACAT<br>1681 TTTGTCTCAGCTTCAGAAAACTTCAAGTGTCTCCATCACAGAAATTATCAGCCCAGGAAG<br>1741 GACAGAGTTAGAGATTGAAGGAGCCCGGGCTGACCTCATTGAGGTGGTTATGAACATTGA<br>1801 AGATATGCTTTGTAAAGTACAGGAGGAAATGGCAAGGAAAAAGGAGCGAGGCCTTTGGCG<br>1861 CTCGTTAGGACAGTGGACTATTCAGCAACAAAAAACCCAAGACGAAATGAAAGAAAATAT<br>1921 CATATTTCTGAAATGTCCTGTGCCTCCAACTCAAGAGCTTCTAGATCAAAAGAAACAGTT<br>1981 TGAAAAATGTGGTTTGCAGGTTCTAAAGGTGGAGAAGATAGACAATGAGGTCCTTATGGC<br>2041 TGCCTTTCAAAGAAAGAAGAAATGATGGAAGAAAAACTGCACAGGCAACCTGTGAGCCA<br>2101 TAGGCTGTTTCAGCAAGTCCCATACCAGTTCTGTGAAGTGGTTTGCAGAGTTGGCTTTCA<br>2161 AAGAATGTACTCGGTGCCCCACGACCCAAAGTATGGACCTGGCATATACTTCACCAAGAA<br>2221 TCTCAAAATCTAGCATCCCAGTTCAAGAAAACGTCTGCCACAGATAAGCTGATCTATGT<br>2281 GTTTGAGGCTGAAGTACTCACAGGCTCCTTCTGTGAGGGTCATCAGTTAAATATTGTTCC<br>2341 CCCACGATTGAGTACTGATGCCATAGATAGCCATGACAGTGTGGTTGACAATGTCTCCAG<br>2401 CCCTGAAACCTTTGTTATTTTTAGTGGCACGCAGGCTATGCCCCAATATTTGTGGACTTG<br>2461 CACCCAGGATCATGTAGGGCCAGAGGATTACTCATTAGGACAAATGTTGCCGTCTCCACA<br>2521 GCAGCTTGGGAAGAGATTCGTAAGTGGCAGCCCTGTTGACTAACTTCTGCATAATTTTAA<br>2581 CAACTGGCATGGCCCTGCTTTGGAAACTAACGAAATATTGACCATCAATGACTCAAAG<br>2641 ACTGGTCTGAATATGTCAAATGGCTCTGGATAGACTGAATGGGTTACTGAAGGGGCCAGC<br>2701 CACATACTAGCATCTTGGTGCCTTCGTCTTTGTTTTCATCTCTTGGGGGTGGGTGGGTA<br>2761 GATACTAACTAAAACACTCTCAGGACCTTCCTTCCTCTTGCAGTTGTTCTTTAATCTCCT<br>2821 TTACTAGAGGAGATAAATATTTTGCATATAATGAAGAAATTTTTCTAGTATATAATTCAA<br>2881 GCCCTCTATTTTTTAAAATGGTGATAGTATAAAAATGTTAGGATAACAGAATGATTTTAG<br>2941 ATTTTCCAGAGAATATTATAAAGTGCTTTAGGTATGAAAATAAATCATCTTTGTCTGATT<br>3001 AAAAAAAAAAAAAAAA | SEQ ID NO: 59 |
| | | 1 M D F S M V A G A A A Y N E K S E T G A<br>1 ATGGACTTTTCCATGGTGGCCGGAGCAGCAGCTTACAATGAAAAATCAGAGACTGGTGCT<br>21 L G E N Y S W Q I P I N H N D F K I L K<br>61 CTTGGAGAAAACTATAGTTGGCAAATTCCCATTAACCACAATGACTTCAAAATTTTAAAA<br>41 N N E R Q L C E V L Q N K F G C I S T L<br>121 AATAATGAGCGTCAGCTGTGTGAAGTCCTCCAGAATAAGTTTGGCTCTATCTCTACCCTG<br>61 V S P V Q E G N S K S L Q V F R K M L T<br>181 GTCTCTCCAGTTCAGGAAGGCAACAGCAAATCTCTGCAAGTGTTCAGAAAAATGCTGACT<br>81 P R I E L S V W K D D L T T H A V D A V<br>241 CCTAGGATAGAGTTATCAGTCTGGAAAGATGACCTCACCACACATGCTGTTGATGCTGTG<br>101 V N A A N E D L L H G G G L A L A L V K<br>301 GTGAATGCAGCCAATGAAGATCTTCTGCATGGGGGAGGCCTGGCCCTGGCCCTGGTAAAA<br>121 A G G F E I Q E E S K Q F V A R Y G K V<br>361 GCTGGTGGATTTGAAATCCAAGAACAGAGCAAACAGTTTGTTGCCAGATATGGTAAAGTG<br>141 S A G E I A V T G A G R L P C K Q I I H<br>421 TCAGCTGGTGAGATAGCHGTCACGGGAGCAGGGAGGCTTCCCTGCAAACAGATCATCCAT<br>161 A V G P R W M E W D K Q G C T G K L Q R<br>481 GCTGTTGGGCCTCGGTGGATGGAATGGGATAAACAGGGATGTACTGGAAAGCTGCAGAGG<br>181 A I V S I L N Y V I Y K N T H I K T V A<br>541 GCCATTGTAAGTATTCTGAATTATGTCATCTATAAAAATACTCACATTAAGACAGTAGCA<br>201 I P A L S S G I F Q F P L N L C T K T I<br>601 ATTCCAGCCTTGAGCTCTGGGATTTTTCAGTTCCCTCTGAATTTGTGTACAAAGACTATT | SEQ ID NO: 60 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 221 V E T I R V S L Q G K P M M S N L K E I<br>661 GTAGAGACTATCCGGGTTAGTTTGCAAGGGAAGCCAATGATGAGTAATTTGAAAGAAATT<br>241 H L V S N E D P T V A A F K A A S E F I<br>721 CACCTGCTGAGCAATGAGGACCCTACTGTTGCTGCCTTTAAAGCTGCTTCAGAATTCATC<br>261 L G K S E L G Q E T T P S F N A M V V N<br>781 CTAGGGAAGAGTGAGCTGGGACAAGAAACCACCCCTTCTTTCAATGCAATGGTCGTGAAC<br>281 N L T L Q I V Q G H I E W Q T A D V I V<br>841 AACCTGACCCTCCAGATTGTCCAGGGCCACATTGAATGGCAGACGGCAGATGTAATTGTT<br>301 N S V N P H D I T V G P V A K S I L Q Q<br>901 AATTCTGTAAACCCACATGATATTACAGTTGGACCTGTGGCAAAGTCAATTCTACAACAA<br>321 A G V E M K S E F L A T K A K Q F Q R S<br>961 GCAGGAGTTGAAATGAAATCGGAATTTCTTGCCACAAAGGCTAAACAGTTTCAACGGTCC<br>341 Q L V L V T K G F N L F C K Y I Y H V L<br>1021 CAGTTGGTACTGGTCACAAAAGGATTTAACTTGTTCTGTAAATATATACCATGTACTG<br>361 W H S E F P K P Q I I K H A M K E C L E<br>1081 TGGCATTCAGAATTTCCTAAACCTCAGATATTAAAACATGCAATGAAGGAGTGTTTGGAA<br>381 K C I E Q N I T S I S F P A L G T G N M<br>1141 AAATGCATTGAGCAAAATATAACTTCCATTTCCTTTCCTGCCCTTGGGACTGGAAACATG<br>401 E I K K E T A A E I L F D E V L T F A K<br>1201 GAAATAAAGAAGGAAACAGCAGCAGAGATTTTGTTTGATGAAGTTTTAACATTTGCCAAA<br>421 D H V K H Q L T V K F V I F P T D L E I<br>1261 GACCATGTAAAACACCAGTTAACTGTAAAATTTGTGATCTTTCCAACAGATTTGGAGATA<br>441 V K A F S S E M A K R S K M L S L N N Y<br>1321 TATAAGGCTTTCAGTTCTGAAATGGCAAAGAGGTCCAAGATGCTGAGTTTGAACAATTAC<br>461 S V P Q S T R E E K R E N G L E A R S P<br>1381 AGTGTCCCCCAGTCAACCAGAGAGGAGAAAAGAGAAATGGGCTTGAAGCTAGATCTCCT<br>481 A I N L M G F N V E E M Y E A H A W I Q<br>1441 GCCATCAATCTGATGGGATTCAACGTCGAAGAGATGTATGAGGCCCACGCATGGATCCAA<br>501 R I L S L Q N H H I I E N N H I L Y L G<br>1501 AGAATCCTGAGTCTCCAGAACCACCACATCATTGAGAATAATCATATTCTGTACCTTGGG<br>521 R K E H D I L S Q L Q K T S S V S I T E<br>1561 AGAAAGGAACATGACATTTTGTCTCAGCTTCAGAAAACTTCAAGTGTCTCCATCACAGAA<br>541 I I S P G R T E L E I E G A R A D L I E<br>1621 ATTATCAGCCCAGGAAGGACAGAGTTAGAGATTGAAGGAGCCCGGGCTGACCTCATTGAG<br>561 V V M N I E D M L C K V Q E E M A R K K<br>1681 GTGGTTATGAACATTGAAGATATGCTTTGTAAAGTACAGGAGGAAATGGCAAGGAAAAAG<br>581 E R G L W R S L G Q W T I Q Q Q K T Q D<br>1741 GAGCGAGGCCTTTGGCGCTCGTTAGGACAGTGGACTATTCAGCAACAAAAAACCCAAGAC<br>601 E M K E N I I F L K C P V P P T Q E L L<br>1801 GAAATGAAAGAAAATATCATATTTCTGAAATGTCCTGTGCCTCCAACTCAAGAGCTTCTA<br>621 D Q K K Q F E K C G L Q V L K V E K I D<br>1861 GATCAAAAGAAACAGTTTGAAAATGTGGTTTGCAGGTTCTAAAGGTGGAGAAGATAGAC<br>641 N E V L M A A F Q R K K K M M E E K L H<br>1921 AATGAGGTCCTTATGGCTGCCTTTCAAAGAAAGAAGAATGATGGAAGAAAAAACTGCAC<br>661 R Q P V S H R L F Q Q V P Y Q F C E V V<br>1981 AGGCAACCTGTGAGCCATAGGCTGTTTCAGCAAGTCCCATACCAGTTCTGTGAAGTGGTT<br>681 C R V G F Q R M Y S V P H D P K Y G P G<br>2041 TGCAGAGTTGGCTTTCAAAGAATGTACTCGGTGCCCCACGACCCAAAGTATGGACCTGGC<br>701 I Y F T K N L K N L A S Q F K K T S A T<br>2101 ATATACTTCACCAAGAATCTCAAAAATCTAGCATCCCAGTTCAAGAAAACGTCTGCCACA<br>721 D K L I Y V F E A E V L T G S F C E G H<br>2161 GATAAGCTGATCTATGTGTTTGAGGCTGAAGTACTCACAGGCTCCTTCTGTGAGGGTCAT<br>741 Q L N I V P P R L S T D A I D S H D S V<br>2221 CAGTTAAATATTGTTCCCCCACGATTGAGTACTGATGCCATAGATAGCCATGACAGTGTG<br>761 V D N V S S P E T F V I F S G T Q A M P<br>2281 GTTGACAATGTCTCCAGCCCTGAAACCTTTGTTATTTTTAGTGGCACGCAGGCTATGCCC<br>781 Q Y L W T C T Q D H V G P E D Y S L G Q<br>2341 CAATATTTGTGGACTTGCACCCAGGATCAlGTAGGGCCAGAGGATTACTCATTAGGACAA<br>801 M L P S P Q Q L G K R F V S G S P V D -<br>2401 ATGTTGCCGTCTCCACAGCAGCTTGGGAAGAGATTCGTAAGTGGCAGCCCTGTTGACTAA | |
| WBC041C11 | Homo sapiens copine I | 1 ACCAGGCAAATATTCCATTCAGCATTACAAAGATGGATGTTCTTCAGTTCCTAGAAGGAA<br>61 TCCCAGTGGATGAAAATGCTGTACATGTTCTTGTTGATAACAATGGGCAAGGTCTAGGAC<br>121 AGGCATTGGTTCAGTTTAAAAATGAAGATGATGCACATGGCCCACTGCGTGACCTTGGTT<br>181 CAGCTGTCCATTTCCTGTGACCATCTCATTGACAAGGACATCGGCTCCAAGTCTGACCCA<br>241 CTCTGCGTCCTTTTACAGGATGTGGAGGGGGCAGCTGGGCTGAGCTTGGCCGGACTGAA<br>301 CGGGTGCGGAACTGCTCAAGCCCTGAGTTCTCCAAGACTCTACAGCTTGAGTACCGCTTT<br>361 GAGACAGTCCAGAAGCTACGCTTTGGAATCTATGACATAGACAACAAGACGCCAGAGCTG<br>421 AGGGATGATGACTTCCTAGGGGGTGCTGAGTGTTCCCTAGGACAGATTGTGTCCAGCCAG<br>481 GTACTGACTCTCCCCTTGATGCTGAAGCTGAAAACCTGCTGGGCGGGGACCATCACG<br>541 GTCTCAGCTCAGGAATTAAGGACAATCGTGTAGTAACCATGGAGGTAGAGGCCAGAAAC<br>601 CTAGATAAGAAGGACTTCCTGGGAAAATCAGATCCATTTCTGGAGTTCTTCCGCCAGGGT<br>661 GATGGGAAATGGCACCTGGTGTACAGATCTGAGGTCATCAAGAACAACCTGAACCCTACA<br>721 TGGAAGCGTTTCTCAGTCCCCGTTCAGCATTTCTGTGGTGGGAACCCCAGCACACCCATC | SEQ ID NO: 61 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 781 CAGGTGCAATGCTCCGATTATGACAGTGACGGGTCACATGATCTCATCGGTACCTTCCAC<br>841 ACCAGCTTGGCCCAGCTGCAGGCAGTCCCGGCTGAGTTTGAATGCATCCACCCTGAGAAG<br>901 CAGCAGAAAAAGAAAAGCTACAAGAACTCTGGAACTATCCGTGTCAAGATTTGTCGGGTA<br>961 GAAACAGAGTACTCCTTTCTGGACTATGTGATGGGAGGCTGTCAGATCAACTTCACTGTG<br>1021 GGCGTGGACTTCACTGGCTCCAATGGAGACCCCTCCTCACCTGACTCCCTACACTACCTG<br>1081 AGTCCAACAGGGGTCAATGAGTACCTGATGCCACTGTGGAGTGTGGGCAGCGTGGTTCAG<br>1141 GACTATGACTCAGACAAGCTGTTCCCTGCATTTGGATTTGGGGCCCAGGTTCCCCCTGAC<br>1201 TGGCAGGTCTCGCATGAATTTGCCTTGAATTTCAACCCCAGTAACCCCTACTGTGCAGGC<br>1261 ATCCAGGGCATTGTGGATGCCTACCGCCAAGCCCTGCCCCAAGTTCGCCTCTATGGCCCT<br>1321 ACCAACTTTGCACCCATCATCAACCATGTGGCCAGGTTTGCAGCCCAGGCTGCACATCAG<br>1381 GGGACTGCCTCGCAATACTTCATGCTGTTGCTGCTGACTGATGGTGCTGTGACGGATGTG<br>1441 GAAGCCACACGTGAGGCTGTGGTGCGTGCCTCGAACCTGCCCATGTCAGTGATCATTGTG<br>1501 GGTGTGGGTGGTGCTGACTTTGAGGCCATGGAGCAGCTGGACGCTGATGGTGGACCCCTG<br>1561 CATACACGTTCTGGGCAGGCTGCTGCCCGCGACATTGTGCAGTTTGTACCCTACCGCCGG<br>1621 TTCCAGAATGCCCCTCGGGAGGCATTGGCACAGACCGTGCTCGCAGAAGTGCCCACACAA<br>1681 CTGGTCTCATACTTCAGGGCCCAGGGTTGGGCCCCGCTCAAGCCACTTCCACCCTCAGCC<br>1741 AAGGATCCTGCACAGGCCCCCAGGCCTAGGTTCCCTTGGAGGCTGTGGCAAGTCCTCAA<br>1801 TCCTGTGTCCCAGAGGTCCCTNTGGGCCACAACCCAACCCTTCTCACTCCTCAGTGCT<br>1861 AGCACTTTGTATTTTTTGATACTTTTATACTTGTTTCTGCTTTTTGCTGCTCTTGATCCCA<br>1921 CCTTTGCTCCTGACAACCCTCATTCAATAAAGACCAGTGAAGACCAAAAAAAAAAAAAAA<br>1981 AAAAA | |
| | |   1 M A H C V T L V Q L S I S C D H L I D K<br>  1 ATGGCCCACTGCGTGACCTTGGTTCAGCTGTCCATTTCCTGTGACCATCTCATTGACAAG<br> 21 D I G S K S D P L C V L L Q D V G G G S<br> 61 GACATCGGCTCCAAGTCTGACCCACTCTGCGTCCTTTTACAGGATGTGGGAGGGGGCAGC<br> 41 W A E L G R T E R V R N C S S P E F S K<br>121 TGGGCTGAGCTTGGCCGGACTGAACGGGTGCGGAACTGCTCAAGCCCTGAGTTCTCCAAG<br> 61 T L Q L E Y R F E T V Q K L R F G I Y D<br>181 ACTCTACAGCTTGAGTACCGCTTTGAGACAGTCCAGAAGCTACGCTTTGGAATCTATGAC<br> 81 I D N K T P E L R D D D F L G G A E C S<br>241 ATAGACAACAAGACGCCAGAGCTGAGGGATGATGACTTCCTAGGGGGTGCTGAGTGTTCC<br>101 L G Q I V S S Q V L T L P L M L K P G K<br>301 CTAGGACAGATTGTGTCCAGCCAGGTACTGACTCTCCCCTTGATGCTGAAGCCTGGAAAA<br>121 P A G R G T I T V S A Q E L K D N R V V<br>361 CCTGCTGGGCGGGGAACCATCACGGTCTCAGCTCAGGAATTAAAGGACAATCGTGTAGTA<br>141 T M E V E A R N L D K K D F L G K S D P<br>421 ACCATGGAGGTAGAGGCCAGAAACCTAGATAAGAAGGACTTCCTGGGAAAATCAGATCCA<br>161 F L E F F R Q G D G K W H L V Y R S E V<br>481 TTTCTGGAGTTCTTCCGCCAGGGTGATGGGAAATGGCACCTGGTGTACAGATCTGAGGTC<br>181 I K N N L N P T W K R F S V P V Q H F C<br>541 ATCAAGAACAACCTGAACCCTACATGGAAGCGTTTCTCAGTCCCCGTTCAGCATTTCTGT<br>201 G G N P S T P I Q V Q C S D Y D S D G S<br>601 GGTGGGAACCCCAGCACACCCATCCAGGTGCAATGCTCCGATTATGACAGTGACGGGTCA<br>221 H D L I G T F H T S L A Q L Q A V P A E<br>661 CATGATCTCATCGGTACCTTCCACACCAGCTTGGCCCAGCTGCAGGCAGTCCCGGCTGAG<br>241 F E C I H P E K Q Q K K K S Y K N S G T<br>721 TTTGAATGCATCCACCCTGAGAAGCAGCAGAAAAAGAAAAGCTACAAGAACTCTGGAACT<br>261 I R V K I C R V E T E Y S F L D Y V M G<br>781 ATCCGTGTCAAGATTTGTCGGGTAGAAACAGAGTACTCCTTTCTGGACTATGTGATGGGA<br>281 G C Q I N F T V G D F T G S N G D P S<br>841 GGCTGTCAGATCAACTTCACTGTGGGCGTGGACTTCACTGGCTCCAATGGAGACCCCTCC<br>301 S P D S L R Y L S P T G V N E Y L M A L<br>901 TCACCTGACTCCCTACACTACCTGAGTCCAACAGGGGTCAATGAGTACCTGATGGCACTG<br>321 W S V G S V V Q D Y D S D K L F P A F G<br>961 TGGACTGTGGGCAGCGTGGTTCAGGACTATGACTCAGACAAGCTGTTCCCTGCATTTGGA<br>341 F G A Q V P P D W Q V S H E F A L N F N<br>1021 TTTGGGGCCCAGGTTCCCCCTGACTGGCAGGTCTCGCATGAATTTGCCTTGAATTTCAAC<br>361 P S N P Y C A G I Q G I V D A Y R Q A L<br>1081 CCCAGTAACCCCTACTGTGCAGGCATCCAGGGCATTGTGGATGCCTACCGCCAAGCCCTG<br>381 P Q V R L Y G P T N F A P I I N H V A R<br>1141 CCCCAAGTTCGCCTCTATGGCCCTACCAACTTTGCACCCATCATCAACCATGTGGCCAGG<br>401 F A A Q A A H Q G T A S Q Y F M L L L L<br>1201 TTTGCAGCCCAGCCTGCACATCAGGGGACTGCCTCGCAATACTTCATGCTGTTGCTGCTG<br>421 T D G A V T D V E A T R E A V V R A S N<br>1261 ACTGATGGTGCTGTGACGGATGTGGAAGCCACACGTGAGGCTGTGGTGCGTGCCTCGAAC<br>441 L P M S V I I V G V G G A D F E A M E Q<br>1321 CTGCCCATGTCAGTGATCATTGTGCTCTCGCGGTGCTGACTTTGAGGCCATGGAGCAG<br>461 L D A D G G P L H T R S G Q A A A R D I<br>1381 CTGGACGCTCATGGTCGACCCCTGCATACACGTTCTCGCCACGCTGCTCCCCGCCACATT<br>481 V Q F V P Y R R F Q N A P R E A L A Q T<br>1441 GTGCACTTTCTACCCTACCCCCGCTTCCAGAATCCCCCTCGCGAGGCATTCGCACACACC | SEQ ID NO: 62 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 501 V L A E V P T Q L V S Y F R A Q G W A P<br>1501 CTGCTCCCAGAACTGCCCACACAACTCGTCTCATACTTCACGGCCCACCGTTGCGCCCCC<br>521 L K P L P P S A K D P A Q A P Q A -<br>1561 CTCAACCCACTTCCACCCTCACCCAACCATCCTCCACAGCCCCCCCAGGCCTAG | |
| WBC036C09_V1.3_AT | *Homo sapiens* delta sleep inducing peptide, immunoreactor, mRNA. | 1 GAAGGCCCCAACCTTACCAGCCGAGAAGCAATTCCTAGCTAGCTTCACAGCCGGTGCCTC<br>61 CGGAGCCAGCGTGGTGGCCATAGACAACAAGATCGAACAGGCATGGATCTGGTGAAGAA<br>121 TCATCTGATGTATGCTGTGAGAGAGGAGGTGGAGATCCTGAAGGAGCAGATCCGAGAGCT<br>181 GGTGGAGAAGAACTCCCAGCTAGAGCGTGAGAACACCCTGTTGAAGACCCTGGCAAGCCC<br>241 AGAGCAGCTGGAGAAGTTCCAGTCCTGTCTGAGCCCTGAAGAGCCAGCTCCCGAATCCCC<br>301 ACAAGTGCCCGAGGCCCCTGGTGGTTCTGCGGTGTAAGTGGCTCTGTCCTCAGGGTGGGC<br>361 AGAGCCACTAAACTTGTTTTACCTAGTTCTTTTCCAGTTTGTTTTTGGCTCCCCAAGCATC<br>421 ATCTCACGAGGAGAACTTTACACCTAGCACAGCTGGTGCCAAGAGATGTCCCAAGGACAT<br>481 GGCCACCTGGGTCCACTCCAGTGACAGACCCCTGACAAAGAGCAAGTCCCTGGAGGCTGA<br>541 GTTGCATGGGGTCTTTGTCACCCCAAGCCAGTGAGCCTCTAATGCCACCGCGCCCTAGGGG<br>601 CTCCCAGAGCCTGGGCAACTTAGCTGTGACTGGCAAAGGAGAAAGGTAGTTTGAGATGTG<br>661 ACGCCAGTTAGTTCCAGAAAGTATCAGGGGTCTGTTTTTCATTTCCATGGACATCTTCAG<br>721 CAGCTTCACCTGACAATGACTGTTCCTATGAAGAAGCCACTTGTGTTTTAAGCAGAGGCA<br>781 ACCTCTCTCTTTTCCCCGCCTCGCCAAGGCAGGGCCACAGATGGGAGAGATTGAGCCAA<br>841 GTCAGCCTTCTGTTGGTAATATGGTCTAATGCATGGCTTTGTGCACAGCCCAGTGTGGG<br>901 ATTACGGCTTTGGGATGACCGCTTACAAAGTTCTGTTTGGTTAGTATCGGCATAGTTTTT<br>961 CTATATAGCCATACATGCGTATATATACCCATAGGGCTAGATCTATATCTTAGTGTAGCG<br>1021 ATGTATACATATACACATACACCTACGTGTCGAAGGGCCTAACCAGCTTTGGGAATATTG<br>1081 ACTGGTTCCTTAECTCTTAAGGCTAATTCTTTGACTGTGTTCATTTACCAAGTTGATCCA<br>1141 GTTTGTCCTTTAGGTTAAATAAGACTAAAGCGTAAAGACAGGGAGGGGGCCAGCCTCTGA<br>1201 ATGTGGCCACAGATGCCTTGCTGCTGCAACCCTTGCCCCATCTGTCCCCTGAAGACTTGT<br>1261 GAGGTCCTCTTTTGAAAGCCAAACCCACCATTCACTGGTGCTGACTACAAAGAATGGGTT<br>1321 TGAGAGAAGATCAGCTAGGACTTCACAGTGTCATTTGAAAACGTTTTTTGTTTTGTTTTG<br>1381 TAATTATTGTGGAAAACTTTCAAGTGAACAGAAGGATGGTGTCCTACTGTGGATGAGGGA<br>1441 TGAACAAGGGGATGGCTTTGATCCAATGGAGCCTGGGAGGTGTGCCCAGAAAGCTTGTCT<br>1501 GTAGCGGGTTTTGTGAGAGTGAACACTTTCCACTTTCTGACACCTGATCCTGATGTATGT<br>1561 TTCCAGGATTTGGATTTTGATTTTTCAGATGTAGCTTGAAATTTCAATAAACTTTGCTCT<br>1621 GTTTTTCTAAAAATAAAAA | SEQ ID NO: 63 |
| | | 1 M D L V K N H L M Y A V R E E V E I L K<br>1 ATGGATCTGGTGAAGAATCATCTGATGTATGCTGTGAGAGAGGAGGTGGAGATCCTGAAG<br>21 E Q I R E L V E K N S Q L E R E N T L L<br>61 GAGCAGATCCGAGAGCTGGTGGAGAAGAACTCCCAGCTAGAGCGTGAGAACACCCTGTTG<br>41 K T L A S P E Q L E K F Q S C L S P E E<br>121 AAGACCCTGGCAAGCCCAGAGCAGCTGGAGAAGTTCCAGTCCTGTCNGAGCCCTGAAGAG<br>61 P A P E S P Q V P E A P G G S A V -<br>181 CCAGCTCCCGAATCCCCACAAGTGCCCGAGGCCCCTGGTGGTTCTGCGGTGTAA | SEQ ID NO: 64 |
| WBC285 | No homology | 1 CTCAGAAAATGCACTCAGACACCGTAATCAGTGGAGCTGCGATCTTATGTACATTTCTAC<br>61 TCTAAAACCTATTTTAAATTTTATCATCTACCGCATGCTATTTCATCNCCTCTCGTCCTC<br>121 TCCCCCTTGTATTTATTAGAGGCTGGCTATGGATTTCTGTCCCTGAGAGCACCTTCCTAA<br>181 CAATGAAGTGTACTTGGCAGTCGCTCACGGTGAATAAGGATTGGAGGATATTCTGCAAGG<br>241 AAAATGGATAGCCTTGTTTCCTCTGTATGAGAGAAATATTTGAGGTAAAATAGACTAATA<br>301 ATTTCTCAAAGTAGAAGTNTTGAGGGTTGCTTTTGCATAGAGAAGTTGGAAACTCCTTGA<br>361 AGTGATAGAAAGCGTGTGGGATATTATAATTATTGTTATTTCCCGCCCNGGCAGGCCGCC<br>421 GCGGGTTTTCTCTTTCCGTGTGCCAGCATCCTTCGAGGTTCAAGGCCACTTCATGTTTTT<br>481 CTTCTGCTTTCTCCACACTGACTTTTTTTGATTTTCATGAGGGGTCTGAGAGAGAAAGCC<br>541 TCCCAGAACCCACTCTCAGTGCTTCCAGCCCTCATTCNTTGATGGATGTTCATGCAATTT<br>601 TCTCATTATTTTTCTGTCAGCATTCACAGAAACAGTGAAAAAGTACTTTATTTCAAGCCA<br>661 TTATGTTAGTTTACTCCATAATAATCTAAGCTGTGTATTCCTTTTCTGATTTGAATTTAG<br>721 TAATAACATATTTTAAAGATAAGTCGAAAAGATTTCCTGAATAAATTTTCGATGACAAC<br>781 TGCTTAAGGTTCAGTTTTTTCCCCTCCTTTAATCTCTCTTATTGGACCGCGGGTTTATCT<br>841 ACTTGATTTAAGTTATCATTTCTTTCTGCACACTTTTAAAACAAACCCTGTGAACTTCTC<br>901 TTGGGA | SEQ ID NO: 65 |
| | | NON CONTIGUOUS<br>1 GCATGCCCCAACCCAACCCCTGGCCCAAGCCACCCCAAGGGGATGATCAGAAACTGCT<br>61 TGAAGGCAGAGTTTCTGAAAATTCTCTTCTCTCCCTCCTGTAAAGGTTTGCATATTTTA<br>121 AATTCTGTTCTTTTCCACAACCCCTCAGCTTCTGGATATAATTTGTGCATAATTGTGTATC<br>181 CTCCTCAAGATTCATCTCCCTCTTCCTCCACCCTTTCTTCAGGTGGAATTTTCTGGG<br>241 TGTCTGATGTTTACACTTTTCCAGACGAGAGTTAAGGGGCCCCTCCCATTTTCTGTCAGA<br>301 TCGTGGATTTCTTTTCCTGTATTGCTTTGGAACTGCAAAACAGATTCTTCTCACCGATGG<br>361 TAGTGTAGAAATCTTCAGGAAAGATGTAAAGATTTTTAAATGCCTCAAAGTGTGGACTTT<br>421 TCTAGATGGTCCCAATATGTCAGTTGCTGTTCTAAAAAAAAAATGTAAAAATCAGATTTC<br>481 TTAGTTTGGTAGGATTAAAAATTATTTCTGGTGCAGTATTCTTTCCGTGATATGGCATTG<br>541 GTGGTCTTGCCTGTATTTTCAGGTAAGCTTTTGGTTGTGTATGTAACTGAACTTTAAAT<br>601 TTCCGGTGCGTTTTATCGGACTGATTCAATTTAGAGGAAGATAAAGGGTGCTGCTCTGAG<br>661 GCTAGGAGATAGTTTTTGAGGTAAAAAAAAAAAAAAAAAAAA | SEQ ID NO: 66 |

TABLE 1-continued

| Gene | GenBank Homology | DNA SEQUENCE/DEDUCED AMINO ACID SEQUENCE | SEQUENCE IDENTIFIER: |
|---|---|---|---|
| WBC030G08_V1.3_AT | Homo sapiens chromosome 6 open reading frame 72, mRNA. | 1 GGGGGCCCTCTGCCCGGGTTGTCCAAGATGGAGGGCGCTCCACCGGGGTCGCTCGCCCTC<br>61 CGGCTCCTGCTGTTCGTGGCGCTACCCGCCTCCGGCTGGCTGACGACGGGCGCCCCCGAG<br>121 CCGCCGCCGCTGTCCGGAGCCCCACAGGACGGCATCAGAATTAATGTAACTACACTGAAA<br>181 GATGATGGGGACATATCTAAACAGCAGGTTGTTCTTAACATAACCTATGAGAGTGGACAG<br>241 GTCTATGTAAATGACCTCCCTGTAAATAGTGGGGTCACCCGAATCAGCTGTCAGACTTTG<br>301 ATAGTGAAGAATGAAAATCTAGGAAATTTGGAGGAAAAAGAATATTTTGGAATTGTCACT<br>361 GTAAGGATTTTAGTTCATGAGTGGCCTATGACATCTGGTTCCAGTTTGCAACTAATTGTC<br>421 ATTCAAGAAGAAGTAGTAGAGATTGATGGAAAACAAGCTCAACAAAAGGATGTCACTGAA<br>481 ATTGATATTTTAGTTAAGAACCAGGGAGTAATCAGACATACAAACTACACCCTGCCTTTG<br>541 GAAGAAAGCATGCTGTACTCCATTTCCCGAGACAATGACGTTTTGTTTACCCTTCCCAAC<br>601 CTCTCCAAAAAAGTAGAAAGTGTTAGTTCGTTGCAGACCACCAGCCAGTACCCCATCAGG<br>661 AGCGTGGAGACCACCGTAGAAGGAGAGGCTCTACCTGGCAAATTACCTGAGACTCCTCTC<br>721 AGAGCAGAGCCTCCGTTTCCCTATAAGGTGATGTGTCAGTGGATGGAGAGGTTCAGGAAG<br>781 GACCTGTGCAGGTTCTGGAGCAGCGTTTGCCCAGTGTTCTTCATGTTTTTGAATGTCATG<br>841 GTGGTCGGAAATATAGGAGCAGCTGTGGTCATAACCATCTTAAAGGTGCTTTTCCCAGTT<br>901 TGTGAATACAAAGGAATTCTTCAGTTGGATAAAGTGAATGTTATACCTGTGACAGCTATC<br>961 AACGTACATCCAGATGGTCCTGAGAAAACAGTGGAAACCGTGGAGATAAAACATGTGTT<br>1021 TAAAACACCGTCTCAAATCATTGACTTTGAATTAGTCTTTTGGCTCTAAATTTGCCACTT<br>1081 GAATATAATTTTCTTTAAATCATTAAGAATCAGTTTCAAAAAAAAAAAAAAAAAAAAA<br>1141 AAAAAA<br><br>1 M E G A P P G S L A L R L L L F V A L P<br>1 ATGGAGGGCGCTCCACCGGGGTCGCTCGCCCTCCGGCTCCTGCTGTTCGTGGCGCTACCC<br>21 A S G W L T T G A P E P P P L S G A P Q<br>61 GCCTCCGGCTGGCTGACGACGGGCGCCCCCGAGCCGCCGCCGCTGTCCGGAGCCCCACAG<br>41 D G I R I N V T T L K D D G D I S K Q Q<br>121 GACGGCATCAGAATTAATGTAACTACACTGAAAGATGATGGGGACATATCTAAACAGCAG<br>61 V V L N I T Y E S G Q V Y V N D L P V N<br>181 GTTGTTCTTAACATAACCTATGAGAGTGGACAGGTCTATGTAAATGACCTCCCTGTAAAT<br>81 S G V T R I S C Q T L I V K N E N L G N<br>241 AGTGGGGTCACCCGAATCAGCTGTCAGACTTTGATAGTGAAGAATGAAAATCTAGGAAAT<br>101 L E E K E Y F G I V T V R I L V H E W P<br>301 TTGGAGGAAAAAGAATATTTTGGAATTGTCACTGTAAGGATTTTAGTTCATGAGTGGCCT<br>121 M T S G S S L Q L I V I Q E E V V E I D<br>361 ATGACATCTGGTTCCAGTTTGCAACTAATTGTCATTCAAGAAGAAGTAGTAGAGATTGAT<br>141 G K Q A Q Q K D V T E I D I L V K N Q G<br>421 GGAAAACAAGCTCAACAAAAGGATGTCACTGAAATTGATATTTTAGTTAAGAACCAGGGA<br>161 V I R H T N Y T L P E E S M L Y S I S<br>481 GTAATCAGACATACAAACTACACCCTGCCTTTGGAACAAAGCATGCTGTACTCCATTTCC<br>181 R D N D V L F T L P N L S K K V E S V S<br>541 CGAGACAATGACGTTTTGTTTACCCTTCCCAACCTCTCCAAAAAAGTAGAAAGTGTTAGT<br>201 S L Q T T S Q Y P I R S V E T T V E G E<br>601 TCGTTGCAGACCACCAGCCAGTACCCCATCAGGAGCGTGGAGACCACCGTAGAAGGAGAG<br>221 A L P G K L P E T P L R A E P P F P Y K<br>661 GCTCTACCTGGCAAATTACCTGAGACTCCTCTCAGAGCAGAGCCTCCGTTTCCCTATAAG<br>241 V M C Q W M E R F K D L C R F W S S V<br>721 GTGATGTGTCAGTGGATGGAGAGGTTCAGGAAGGACCTGTGCAGGTTCTGGAGCAGCGTT<br>261 C P V F F M F L N V M V V G N I G A A V<br>781 TGCCCAGTGTTCTTCATGTTTTTGAATGTCATGGTGGTCGGAAATATAGGAGCAGCTGTG<br>281 V I T I L K V L F P V C E Y K G I L Q L<br>841 GTCATAACCATCTTAAAGGTGCTTTTCCCAGTTTGTGAATACAAAGGAATTCTTCAGTTG<br>301 D K V N V I P V T A I N V H P D G P E K<br>901 GATAAAGTGAATGTTATACCTGTGACAGCTATCAACGTACATCCAGATGGTCCTGAGAAA<br>321 T V E N R G D K T C V -<br>961 ACAGTGGAAACCGTGGAGATAAAACATGTGTTTAA | SEQ ID NO: 67<br><br><br><br><br><br><br>SEQ ID NO: 68 |
| WBC024D07 | Homo sapiens heat shock 70 kDa protein 8, transcript variant 1 | 1 CTCTTGGGTTTTTTGTGGCTTCCTTCGTTATTGGAGCCAGGCCTACACGCCAGCAACCAT<br>61 GTCCAAGGGACCTGCAGTTGGTATTGATCTTGGCACCACCTACTCTTGTGTGGGTGTTTT<br>121 CCAGCACGGAAAAGTCGAGATAATTGCCAATGATCAGGGAAACCGAACCACTCCAAGCTA<br>181 TGTCGCCTTTACGGACACTGAACGGTTGATCGGTGATGCCGCAAAGAATCAAGTTGCAAT<br>241 GAACCCCACCAACACAGTTTTTGATGCCAAACGTCTGATTGGACGCAGATTTGATGATGC<br>301 TGTTGTCCAGTCTGATATGAAACATTGGCCCTTTATGGTGGTAATGATGCTGGCAGGCC<br>361 CAAGGTCCAAGTAGAATACAAGGGAGAGACCAAAAGCTTCTATCCAGAGGAGGTGTCTTC<br>421 TATGGTTCTGACAAAGATGAAGGAAATTGCAGAAGCCTACCTTGGGAAGACTGTTACCAA<br>481 TGCTGTGGTCACAGTGCCAGCTTACTTTAATGACTCTCAGCGTCAGGCTACCAAAGATGC<br>541 TGGAACTATTGCTGGTCTCAATGTACTTAGAATTATTAATGAGCCAACTGCTGCTGCTAT<br>601 TGCTTACGGCTTAGACAAAAGGTTGGAGCAGAAAGAAACGTGCTCATCTTTGACCTGGG<br>661 AGGTGGCACTTTTGATGTGTCAATCCTCACTATTGAGGATGGAATCTTTGAGGTCAAGTC<br>721 TACAGCTGGAGACACCCACTTGGGTGGAGAAGATTTTGACAACCGAATGGTCAACCATTT<br>781 TATTGCTGAGTTTAAGCGCAAGCATAAGAAGGACATCAGTGAGAACAAGAGAGCTGTAAG<br>841 ACGCCTCCGTACTGCTTGTGAACGTGCTAAGCGTACCCTCTCTTCCAGCACCCAGGCCAG<br>901 TATTGAGATCGATTCTCTCTATGAAGGAATCGACTTCTATACCTCCATTACCCGTGCCCG<br>961 ATTTGAAGAACTGAATGCTGACTGTTCCGTGGCACCCTGGACCCAGTGAGAAAGCCCT<br>1021 TCGAGATGCCAAACTAGACAAGTCACAGATTCATGATATTGTCCTGGTTGGTGGTTCTAC | SEQ ID NO: 69 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 1081 TCGTATCCCCAAGATTCAGAAGCTTCTCCAAGACTTCTTCAATGGAAAAGAACTGAATAA<br>1141 GAGCATCAACCCTGATGAAGCTGTTGCTTATGGTGCAGCTGTCCAGGCAGCCATCTTGTC<br>1201 TGGAGACAAGTCTGAGAATGTTCAAGATTTGCTGCTCTTGGATGTCACTCCTCTTTCCCT<br>1261 TGGTATTGAAACTGCTGGTGGAGTCATGACTGTCCTCATCAAGCGTAATACCACCATTCC<br>1321 TACCAAGCAGACACAGACCTTCACTACCTATTCTGACAACCAGCCTGGTGTGCTTATTCA<br>1381 GGTTTATGAAGGCGAGCGTGCCATGACAAAGGATAACAACCTGCTTGGCAAGTTTGAACT<br>1441 CACAGGCATACCTCCTGCACCCCGAGGTGTTCCTCAGATTGAAGTCACTTTTGACATTGA<br>1501 TGCCAATGGTATACTCAATGTCTCTGCTGTGGACAAGAGTACGGGAAAAGAGAACAAGAT<br>1561 TACTATCACTAATGACAAGGGCCGTTTGAGCAAGGAAGACATTGAACGTATGGTCCAGGA<br>1621 AGCTGAGAAGTACAAAGCTGAAGATGAGAAGCAGAGGGACAAGGTGTCATCCAAGAATTC<br>1681 ACTTGAGTCCTATGCCTTCAACATGAAAGCAACTGTTGAAGATGAGAAACTTCAAGGCAA<br>1741 GATTAACGATGAGGACAAACAGAAGATTCTGGACAAGTGTAATGAAATTATCAACTGGCT<br>1801 TGATAAGAATCAGACTGCCGAGAAGGAAGAATTTGAACATCAACAGAAAGAGCTGGAGAA<br>1861 AGTTTGCAACCCCATCATCACCAAGCTGTACCAGAGTGCAGGAGGCATGCCAGGAGGAAT<br>1921 GCCTGGGGGATTTCCTGGTGGTGGAGCTCCTCCCTCTGGTGGTGCTTCCTCAGGGCCCAC<br>1981 CATTGAAGAGGTTGATTAAGCCAACCAAGTGTAGATGTAGCATTGTTCCACACATTTAAA<br>2041 ACATTTGAAGGACCTAAATTCGTAGCAAATTCTGTGGCAGTTTTAAAAGTTAAGCTGCT<br>2101 ATAGTAAGTTACTGGGCATTCTCAATACTTGAATATGGAACATATGCACAGGGGAAGGAA<br>2161 ATAACATTGCACTTTATAAACACTGTATTGTAAGTGGAAAATGCAATGTCTTAAATAAAA<br>2221 CTATTTAAAATTGGCACCATAAACAAAAAAAAAAAAAA | |
| | |    1 M  S  K  G  P  A  V  G  I  D  L  G  T  T  Y  S  C  V  G  V<br>   1 ATGTCCAAGGGACCTGCAGTTGGTATTGATCTTGGCACCACCTACTCTTGTGTGGGTGTT<br>  21 F  Q  H  G  K  V  E  I  I  A  N  D  Q  G  N  R  T  T  P  S<br>  61 TTCCAGCACGGAAAAGTCGAGATAATTGCCAATGATCAGGGAAACCGAACCACTCCAAGC<br>  41 Y  V  A  F  T  D  T  E  R  L  I  G  D  A  A  K  N  Q  V  A<br> 121 TATGTCGCCTTTACGGACACTGAACGGTTGATCGGTGATGCCGCAAAGAATCAAGTTGCA<br>  61 M  N  P  T  N  T  V  F  D  A  K  R  L  I  G  R  R  F  D  D<br> 181 ATGAACCCCACCAACACAGTTTTTGATGCCAAACGTCTGATTGGACGCAGATTTGATGAT<br>  81 A  V  V  Q  S  D  M  K  H  W  P  F  M  V  V  N  D  A  G  R<br> 241 GCTGTTGTCCAGTCTGATATGAAACATTGGCCCTTTATGGTGGTGAATGATGCTGGCAGG<br> 101 P  K  V  Q  V  E  F  Y  P  E  E  V  S<br> 301 CCCAAGGTCCAAGTAGAATACAAGGGAGAGACCAAAAGCTTCTATCCAGAGGAGGTGTCT<br> 121 S  M  V  L  T  K  M  K  E  I  A  E  A  Y  L  G  K  T  V  T<br> 361 TCTATGGTTCTGACAAAGATGAAGGAAATTGCAGAAGCCTACCTTGGGAAGACTGTTACC<br> 141 N  A  V  V  T  V  P  A  Y  F  N  D  S  Q  R  Q  A  T  K  D<br> 421 AATGCTGTGGTCACAGTGCCAGCTTACTTTAATGACTCTCAGCGTCAGGCTACCAAAGAT<br> 161 A  G  T  I  A  G  L  N  V  L  R  I  I  N  E  P  T  A  A  A<br> 481 GCTGGAACTATTGCTGGTCTCAATGTACTTAGAATTATTAATGAGCCAACTGCTGCTGCT<br> 181 I  A  Y  G  L  D  K  K  V  G  A  E  R  N  V  L  I  F  D  L<br> 541 ATTGCTTACGGCTTAGACAAAAAGGTTGGAGCAGAAAGAAACGTGCTCATCTTTGACCTG<br> 201 G  G  G  T  F  D  V  S  I  L  T  I  E  D  G  I  F  E  V  K<br> 601 GGAGGTGGCACTTTTGATGTGTCAATCCTCACTATTGACGATGGAATCTTTGAGGTCAAG<br> 221 S  T  A  G  D  T  H  L  G  G  E  D  F  D  N  R  M  V  N  H<br> 661 TCTACAGCTGGAGACACCCACTTGGGTGCAGAAGATTTTGACAACCCAATGGTCAACCAT<br> 241 F  I  A  E  F  K  R  K  H  K  K  D  I  S  E  N  K  R  A  V<br> 721 TTTATTGCTGAGTTTAAGCGCAAGCATAAGAAGGACATCAGTGAGAACAAGAGAGCTGTA<br> 261 R  R  L  R  T  A  C  E  R  A  K  R  T  L  S  S  S  T  Q  A<br> 781 AGACGCCTCCGTACTGCTTGTGAACGTGCTAAGCGTACCCTCTCTTCCAGCACCCAGGCC<br> 281 S  I  E  I  D  S  L  Y  K  G  I  D  F  Y  T  S  I  T  R  A<br> 841 AGTATTGAGATCGATTCTCTCTATGAAGGAATCGACTTCTATACCTCCATTACCCGTGCC<br> 301 R  F  E  E  L  N  A  D  L  F  R  G  T  L  D  P  V  E  K  A<br> 901 CGATTTGAAGAACTGAATGCTGACCTGTTCCGTGGCACCCTGGACCCAGTAGAGAAAGCC<br> 321 L  R  D  A  K  L  D  K  S  Q  I  H  D  I  V  L  V  G  G<br> 961 CTTCGAGATGCCAAACTAGACAAGTCACAGATTCATGATATTGTCCTGGTTGGTGGTTCT<br> 341 T  R  I  P  K  I  Q  K  L  L  Q  D  F  F  N  G  K  E  L  N<br>1021 ACTCGTATCCCCAACATTCAGAAGCTTCTCCAAGACTTCTTCAATGGAAAAGAACTGAAT<br> 361 K  S  I  N  P  D  E  A  V  A  Y  G  A  A  V  Q  A  A  I  L<br>1081 AAGAGCATCAACCCTGATGAAGCTGTTGCTTATGGTGCAGCTGTCCAGGCAGCCATCTTG<br> 381 S  G  D  K  S  E  N  V  Q  D  L  L  L  L  D  V  T  P  L  S<br>1141 TCTGGAGACAAGTCTGAGAATGTTCAAGATTTGCTGCTCTTGGATGTCACTCCTCTTTCC<br> 401 L  G  I  E  T  A  G  G  V  M  T  V  L  I  K  R  N  T  T  I<br>1201 CTTGGTATTGAAACTGCTGGTGGAGTCATGACTGTCCTCATCAAGCGTAATACCACCATT<br> 421 P  T  K  Q  T  Q  T  F  T  T  Y  S  D  N  Q  P  G  V  L  I<br>1261 CCTACCAAGCAGACACAGACCTTCACTACCTATTCTGACAACCAGCCTGGTGTGCTTATT<br> 441 Q  V  Y  E  G  E  R  A  M  T  K  D  N  N  L  L  G  K  F  E<br>1321 CAGGTTTATGAAGGCGAGCGTGCCATGACAAAGGATAACAACCTGCTTGGCAAGTTTGAA<br> 461 L  T  G  I  P  P  A  P  R  G  V  P  Q  I  E  V  T  F  D  I<br>1381 CTCACAGGCATACCTCCTGCACCCCGAGGTGTTCCTCAGATTGAAGTCACTTTTGACATT<br> 481 D  A  N  G  I  L  N  V  S  A  V  D  K  S  T  G  K  E  N  K<br>1441 GATGCCAATGGTATACTCAATGTCTCTGCTGTGGACAAGAGTACGGGAAAAGAGAACAAG<br> 501 I  T  I  T  N  D  K  G  R  L  S  K  E  D  I  E  R  M  V  Q<br>1501 ATTACTATCACTAATGACAAGGGCCGTTTGAGCAAGGAAGACATTGAACGTATGGTCCAG | SEQ ID NO: 70 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 521 E A E K Y K A E D E K Q R D K V S S K N<br>1561 GAAGCTGAGAAGTACAAAGCTGAAGATGAGAAGCAGAGGGACAAGGTGTCATCCAAGAAT<br>541 S L E S Y A F N M K A T V E D E K L Q G<br>1621 TCACTTGAGTCCTATGCCTTCAACATGAAAGCAACTGTTGAAGATGAGAAACTTCAAGGC<br>561 K I N D E D K Q K I L D K C N E I I N W<br>1681 AAGATTAACGATGAGGACAAACAGAAGATTCTGGACAAGTGTAATGAAATTATCAACTGG<br>581 L D K N Q T A E K E E F E H Q Q K E L E<br>1741 CTTGATAAGAATCAGACTGCCGAGAAGGAAGAATTTGAACATCAACAGAAAGAGCTGGAG<br>601 K V C N P I I T K L Y Q S A G G M P G G<br>1801 AAAGTTTGCAACCCCATCATCACCAAGCTGTACCAGAGTGCAGGAGGCATGCCAGGAGGA<br>621 M P G G F P G G G A P P S G G A S S G P<br>1861 ATGCCTGGGGGATTTCCTGGTGGTGGAGCTCCTCCCTCTGGTGGTGCTTCCTCAGGGCCC<br>641 T I E E V D -<br>1921 ACCATTGAAGAGGTTGATTAA | |
| WBC031E09_V1.3_AT | Human KV12 protein gene, exon 1. | 1 TAATAGAAATTAAAATGCTTCTTCATACATAGCTGAATAGAAAAGAATTTGTTGAGAAGG<br>61 AATTCAGGGTAGCGAATATTAGGGCATAAGCTTGTAGTTTACTTGTAACATCTCAACACTA<br>121 TCTTTTAACTACAATTACCAAAAACTAGGATCCATTATTCTTTCACAAACTAACAAATTA<br>181 TATTGCTATCCAACAGATTGCCAAGTATGCCCACGGACATGGAACACACAGGACATTAC<br>241 CTACATCTTGCCTTTCTGATGACAACAGTTTTTTCTTTGTCTCCTGGAACAAAAGCAAAC<br>301 TATACCCGTCTGTGGGCTAACAGTACTTCTTCCTGGGATTCAGTTATTCAAAACAAGACA<br>361 GGCAGAAACAAAAATGAAAACATTAATATAAACCCTGCAACTCCTGAAGTAGATAAAAAA<br>421 GATAACTCTACAAGCATGCCTGAAATAGCAACATCAGCTCACATTGTACCCTTAACTCCT<br>481 AAATCTCAACCGGAGCTTTATATACCTTCTGTTGTCAGGAACAGTTCTCCAACAGTACAG<br>541 AGCATTGAAAACACAAGCAAGAGTCACAGTGAAATTTTCAAAAAAGATGTCTGTGAGGAA<br>601 AACTACAACAAAATCGCTATGCTAGTTTGTGTAATTATAATTGCAGTGCTTTTTCTTATC<br>661 TGTACCCTTCTATTTCTATCAACTGTGGTTCTGGCAAACAAAGTCTCATCTCTCAGACGA<br>721 TCAACAAGCAGGCAACGTCAGCCTAGAAGCAACGGCGATTTTCTGGCAAAAGCAGAAGGT<br>781 CTATGGCCTGCTGACTCAGATACTTGGAAAAGAGCTAAAACAGCTCACAGGCCCCACCTA<br>841 ATGATGCCATCTACTGGAGCACTCACAGCTACAATGGAAAGAAAAGATGAAGAAAGAACT<br>901 GAAAAACTCACTAACTGATGCTTAGTGAAGAAAAATGCAAAGTGGCTATGAGAAAGTTT<br>961 AGAGTAAAAATGAAGTCAGTTTGATATTTAATGCCAACAGGTTGGTCTGATGGTCTGAAA<br>1021 TCTGATGGGCAGGCCTTGCGATTTAAAATGAAGCAGGTGAGAAGGGGAGAAGCATGCCTG<br>1081 CTTACTTAATGACTGAAACTGTGCACTTTTGTTCTGACACTGAATATCTTAAAGAGCAAA<br>1141 TAATAAAACAACCAAGCATCTGGGGAAGGTTTTGAAGATGACTTGAAGGAACTGACTAAT<br>1201 AGAAAGGGTCAATTAAATAAATATTTCCTGTTCCATAATAGTAGTTAGATGATCTTTGTT<br>1261 CGAATGTAATTAAATTTTGAAAAGTTTTAGCATGTCCTTAGAGGCAAGTATATGCTTCAA<br>1321 CACCTAACAGAAGTAAAAATTCTAATGCATAGAGATGAACTGTATAGTTTAATGGTACCT<br>1381 TCTTTTGCTGAATGTGACAGAATCCATACCAGCTCATGTATCAACACAGCTAATTTTAAGC<br>1441 AGGATGTTTTCATCTTTACATATGGCACATATAAAAAGGTGCTTTTCTACTATTAATATT<br>1501 AAAATTAAAACCTTTACTTTTGTATAATAAATTAAAACTCAGAATAAACCTGTGACCACGT<br>1561 ATATTTGCATTCACTTTATTACTTTAGAGAACACATTGTAAAGATCAATAAGAAATAGAG<br>1621 CACAACTAAAATAAATAAGATTTATAGCCACACCAATAGGCTAGTGTAAACGAAAGTATG<br>1681 TTTCACTGTTTATGATTAATAAATATTCATCTTTTCTATAAATACTACTTACTGGAACATT<br>1741 AACAACAAGTCCAAAGGTTGATTAATTTTGACTCAGGAGCAGAGCTATGATTATA | SEQ ID NO: 71 |
| | | 1 M P T D M E H T G H Y L H L A F L M T T<br>1 ATGCCCACGGACATGGAACACACAGGACATTACCTACATCTTGCCTTTCTGATGACAACA<br>21 V F S L S P G T K A N Y T R L W A N S T<br>61 GTTTTTTCTTTGTCTCCTGGAACAAAAGCAAACTATACCCGTCTGTGGGCTAACAGTACT<br>41 S S W D S V I Q N K T G R N K N E N I N<br>121 TCTTCCTGGGATTCAGTTATTCAAAACAAGACAGGCAGAAACAAAAATGAAAACATTAAT<br>61 I N P A T P E V D K K D N S T S M P E I<br>181 ATAAACCCTGCAACTCCTGAAGTAGATAAAAAAGATAACTCTACAAGCATGCCTGAAATA<br>81 A T S A H I V P L T P K S Q P E L Y I P<br>241 GCAACATCAGCTCACATTGTACCCTTAACTCCTAAATCTCAACCGGAGCTTTATATACCT<br>101 S V V R N S S P T V Q S I E N T S K S H<br>301 TCTGTTGTCAGGAACAGTTCTCCAACAGTACAGAGCATTGAAAACACAAGCAAGAGTCAC<br>121 S E I F K K D V C E E N Y N K I A M L V<br>361 AGTGAAATTTTCAAAAAAGATGTCTGTGAGGAATACAACAAAATCGCTATGCTAGTT<br>141 C V I I A V L F L I C T L L F L S T V<br>421 TGTGTAATTATAATTGCAGTGCTTTTTCTTATCTGTACCCTTCTATTTCTATCAACTGTG<br>161 V L A N K V S S L R R S K Q A G K R Q P<br>481 GTTCTGGCAAACAAAGTCTCATCTCTCAGACGATCAAAACAAGCAGGCAAACGTCAGCCT<br>181 R S N G D F L A S S G L W P A D S D T W<br>541 AGAAGCAACGGCGATTTTCTGGCAAGCAGTGGTCTATGGCCTGCTGACTCAGATACTTGG<br>201 K R A K Q L T G P H L M M P S T G A L T<br>601 AAAAGAGCAAAACAGCTCACAGGGCCCCACCTAATGATGCCATCTACTGGAGCACTCACA<br>221 A T M E R K D E E R T E K L T N -<br>661 GCTACAATGGAAAGAAAAGATGAAGAAAGAACTGAAAAACTCACTAACTGA | SEQ ID NO: 72 |

TABLE 1-continued

| Gene | GenBank Homology | DNA SEQUENCE/DEDUCED AMINO ACID SEQUENCE | SEQUENCE IDENTIFIER: |
|---|---|---|---|
| BM734613 | *Homo sapiens* presenilin-associated protein mRNA. | 1 CGGTGCCGCGGGGATGGCGGGAGCCGGAGCTGGAGCCGGAGCTCGCGGCGGAGCGGCGGC<br>61 GGGGGTCGAGGCTCGAGCTCGCGATCCACCGCCCGCGCACCGCGCACATCCTCGCCACCC<br>121 TCGGCCTGCGGCTCAGCCCTCGGCCCGCAGGATGGATGGCGGGTCAGGGGGCCTGGGGTC<br>181 TGGGGACAACGCCCCGACCACTGAGGCTCTTTTCGTGGCACTGGGCGCGGGCGTGACGGC<br>241 GCTCAGCCATCCCCTGCTCTACGTGAAGCTGCTCATCCAGGTGGGTCATGAGCCGATGCC<br>301 CCCCACCCTTGGGACCAATGTGCTGGGGAGGAAGGTCCTCTATCTGCCGAGCTTCTTCAC<br>361 CTACGCCAAGTACATCGTGCAAGTGGATGGTAAGATAGGGCTGTTCCGAGGCCTGAGTCC<br>421 CCGGCTGATGTCCAACGCCCTCTCTACTGTGACTCGGGGTAGCATGAAGAAGGTTTTCCC<br>481 TCCAGATGAGATTGAGCAGGTTTCCAACAAGGATGATATGAAGACTTCCCTGAAGAAAGT<br>541 TGTGAAGGAGACCTCCTACGAGATGATGATGCAGTGTGTGTCCCGCATGTTGCCCCACCC<br>601 CCTGCATGTCATCTCAATGCGCTGCATGGTCCAGTTTGTGGGACGGGAGGCCAAGTACAG<br>661 TGGTGTGCTGAGCTCCATTGGGAAGATTTTCAAAGAGGAAGGGCTGCTGGGATTCTTCGT<br>721 TGGATTAATCCCTCACCTCCTGGGCGATGTGGTTTTCTTGTGGGGCTGTAACCTGCTGGC<br>781 CCACTTCATCAATGCCTACCTGGTGGATGACAGCGTGAGTGACACCCCAGGGGGCTGGG<br>841 AAACGACCAGAATCCAGGTTCCCAGTTCAGCCAGGCCCTGGCCATCCGGAGCTATACCAA<br>901 GTTCGTGATGGGGATTGCAGTGAGCATGCTGACCTACCCCTTCCTGCTAGTTGGCGACCT<br>961 CATGGCTGTGAACAACTGCGGGCTGCAAGCTGGGCTCCCCCCTTACTCCCCAGTGTTCAA<br>1021 ATCCTGGATTCACTGCTGGAAGTACCTGAGTGTGCAGGGCCAGCTCTTCCGAGGCTCCAG<br>1081 CCTGCTTTTCCGCCGGGTGTCATCAGGATCATGCTTTGCCCTGGAGTAACCTGAATCATC<br>1141 TAAAAAACACGGTCTCAACCTGGCCACCGTGGGTGAGGCCTGACCACCTTGGGACACCTG<br>1201 CAAGACGACTCCAACCCAACAACAACCAGATGTGCTCCAGCCCAGCCGGGCTTCAGTTCC<br>1261 ATATTTGCCATGTGTCTGTCCAGATGTGGGGTTGAGCGGGGGTGGGGCTGCACCCAGTGG<br>1321 ATTGGGTCACCCGGCAGACCTAGGGAAGGTGAGGCGAGGTGGGGAGTTGGCAGAATCCCC<br>1381 ATACCTCGCAGATTTGCTGAGTCTGTCTTGTGCAGAGGGCCAGAGAACGACTTGTGGAGG<br>1441 CCTAGGTTGGATGGGAAAGGCTCGCGGGGTCAGGTCCCACCCGTCTACCCCTCCAGTCA<br>1501 GCCCAGCGCCCATCCTGCAGCTCAGCTGGGAGCACTGCCCTCCTGCTTTGTACATAGGGC<br>1561 GTGATCCCCTTTCACCAGGCCACCACCATGTCCAGGCCTGTGCCAGGAAGCCATTGCTCA<br>1621 GTTCTACCTTTGTTTTTCTCAACACTACCTTTTTGATACGAAGGCAGCACCTTCGGAATG<br>1681 TGAAATCATGTACTGCTCAGAATGTGTCCCTCTCATCAAGTGCTCATTGGTTThATGGTG<br>1741 ACGCCTCCTGTGCAGGATCTGGTCACCTGTGCATTTGTGAACACCCAGGAATTAGGCAGA<br>1801 TCACCGTCTCTTGTCTACCCAGTTTAACAATTTGTGATAAGATTTGACCGTTTCTCCCTC<br>1861 AAATAAATGTATTGGTGATTTGGAAAAAAAAAAAAAAAAAAAAAAAAAAAA | SEQ ID NO: 73 |
| | | 1 M A G A G A G A G A R G G A A A G V E A<br>1 ATGGCGGGAGCCGGAGCTGGAGCCGGAGCTCGCGGCGGAGCGGCGGCGGGGGTCGAGGCT<br>21 R A R D P P P A H R A H P R P A A<br>61 CGAGCTCGCGATCCACCGCCCGCGCACCGCGCACATCCTCGCCACCCTCGGCCTGCGCCT<br>41 Q P S A R R M D G G S G G L G S G D N A<br>121 CAGCCCTCGGCCCGCAGGATGGATGGCGGGTCAGGGGGCCTGGGGTCTGGGGACAACGCC<br>61 P T T E A L F V A L G A G V T A L S H P<br>181 CCGACCACTGAGGCTCTTTTCGTGGCACTGGGCGCGGGCGTGACGGCGCTCAGCCATCCC<br>81 L L Y V K L L I Q V G H E P M P P T L G<br>241 CTGCTCTACGTGAAGCTGCTCATCCAGGTGGGTCATGAGCCGATGCCCCCCACCCTTGGG<br>101 T N V L G R K V L Y L P S F F T Y A K Y<br>301 ACCAATGTGCTGGGGAGGAAGGTCCTCTATCTGCCGAGCTTCTTCACCTACGCCAAGTAC<br>121 I V Q V D G K I G L F R G L S P R L M S<br>361 ATCGTGCAAGTGGATGGTAAGATAGGGCTGTTCCGAGGCCTGAGTCCCCGGCTGATGTCC<br>141 H A L S T V T R G S M K K V F P P D E I<br>421 AACGCCCTCTCTACTGTGACTCGGGGTAGCATGAAGAAGGTTTTCCCTCCAGATGAGATT<br>161 E Q V S N K D D M K T S L K K V V K E T<br>481 GAGCAGGTTTCCAACAAGGATGATATGAAGACTTCCCTGAAGAAAGTTGTGAAGGAGACC<br>181 S Y E M M M Q C V S R M L A H P L H V I<br>541 TCCTACGAGATGATGATGCAGTGTGTGTCCCGCATGTTGCCCCACCCCCTGCATGTCATC<br>201 S M R C M V Q F V G R E A K Y S G V L S<br>601 TCAATGCGCTGCATGGTCCAGTTTCTGGGACGGGAGGCCAAGTACAGTGGTGTGCTGACC<br>221 S I G K I F K E E G L L G F F V G L I P<br>661 TCCATTGGGAAGATTTTCAAAGACCAACGGCTCCTCCGATTCTTCGTTCGATTAATCCCT<br>241 H L L G D V V F L W G C N L L A H F I N<br>721 CACCTCCTGCCCCATCTCGTTTTCTTGTGGCCCTGTAACCTCCTCCCCCACTTCATCAAT<br>261 A Y L V D D S V S D T P G G L G N D Q N<br>781 CCCTACCTCCTGCATGACAGCCTGACTGACACCCCAGGCCCGCTGGGAAACGACCACAAT<br>281 P G S Q F S Q A L A I R S Y T K F V M G<br>841 CCACGTTCCCACTTCAGCCACGCCCTGGCCATCCGGACCTATACCAAGTTCCTCATGGCC<br>301 I A V S M L T Y P F L L V G D L M A V N<br>901 ATTGCACTGACCATGCTCACCTACCCCTTCCTCCTACTTCGCGACCTCATGCCTGTGAAC<br>321 N C G L Q A G L P P Y S P V F K S W I H<br>961 AACTGCGGGCTGCAAGCTGGGCTCCCCCCTTACTCCCCAGTGTTCAAATCCTGGATTCAC<br>341 C W K Y L S V Q G Q L F R G S S L L F R<br>1021 TGCTGGAAGTACCTGAGTGTGCAGGGCCAGCTCTTCCGAGGCTCCAGCCTGCTTTTCCGC<br>361 R V S S G S C F A L E -<br>1081 CGGGTGTCATCAGGATCATGCTTTGCCCTGGAGTAA | SEQ ID NO: 74 |

TABLE 1-continued

| Gene | GenBank Homology | DNA SEQUENCE/DEDUCED AMINO ACID SEQUENCE | SEQUENCE IDENTIFIER: |
|---|---|---|---|
| WBC012F12_V1.3_AT | No Homology | 1 GACCACAACTGAAATGTGCAACTGTGCACTNGGGGGGATTNTGGGGAGAAAAAAAAGCA<br>61 GGAAAAAATGTATCTTTAACAGATAAGATCTTTTTAACAAAACCATGGTATCATTGTCAC<br>121 TTGCCAAAATTAATGATTTCCTTAATTAGCATATAATAATCAGTCTGTATTCAGTTTTCC<br>181 TTTCAAAATATCTTTCTGCTGGTTGTTTAAATGAGGATCCAACACTGCATTTAGTTGCT<br>241 GTCTCTTTTACTCTATAACATTGACCCCTGTCTTTAATTTCTTTCCTCTTCCCAGTTATT<br>301 TGAGAAGGGAACTGGATCATATATCCTGTAGAATTTCCTTCGTTCAGGTTTTGACTGACG<br>361 GTATCCACATGATGTCTAGTTAGAACTAGAAGGTTGATTTGATTCTGGTTCAAAAATTTT<br>421 TTCCAAGAATACTCCATAGGTGATGCTATATACTTTCTTTTGCATCACGTCCTGAGGAAC<br>481 ACGATGTCTGGTTGTTCCACTGTTGGTGATGTCTGGATTGATCGGTGGTTTCTAGTGGTG<br>541 TCATCTACTATAAAGCTTCCTATCTATCTTTCACCCAATGGTTTGAGCAACCATTGATGA<br>601 TTGTTACCTGAATCCATTATTTTATTAGGGGTTGCAAAACAGTGACTTTTGGATTCTATC<br>661 AAACCTCTTGCATTTATCATCTGTGATTCTTGTAGAAAGAAGAACTTTGTCTAAAGCTGA<br>721 TTGGGAAAGATGGAATAAATAATTAATTTATTCATCTTTAGAATGAGTTGGTGCCCTAAC<br>781 AACCTCCAAAGGTGATAAATGAGGTCTTCGTTTTCTAAGTAGGGGTATGACTAAACCAGT<br>841 ACTTTGAAACAGTGTGTTTTAGAATGGGCTG | SEQ ID NO: 75 |
| | | NON CONTIGUOUS<br>1 AACAGTTGATGGACATTTGGTTTGTTTCTACTTTCCTGCTATTATGAACAATGCTACTAT<br>61 GAATATTCGTGTACAAGTGTCACGTGGACATATTTCCATTTCTCTCGTGTGTACACCTAG<br>121 CAGTGGAAATGCTGAGTCATACTGTAACTCCTTCCTCCTAACTTTGCATATCAAAGTTAT<br>181 GTTCGGAACTCAGATTCAGTGCTACTTCTATAGTGTTCTGCCATCTCACACTCAGAACGA<br>241 AACTCCCCTCTAGTACTCCCAGTGTTGAGTGCCTCAGTATTGCGCTTACCAGTTTGCCCT<br>301 GGAGTCTGTTATTCCTGCGTGGCTGTTCTCCTCCTACTGTGAATTTCTGGAAAACAGGGAC<br>361 AGGCTCTCATTTTTGTCTGTCCCAAGACAGCGACTGTACCGCCCTGCATAAAGCAGGAAC<br>421 TCTGTAAGTCCTTTCGAACGGGTGGGTAATACAAGTGTTAAGAATTTCATGTGCTTGATT<br>481 CTATAAAATGTGTTTAATATTAAATAATAATAATGTTCACTTTCAAATTTCAACAATTAA<br>541 ATGTTTGTCAAATAACATTTAAAGTAAAGGTGTATAAGGTAAACCAGTTTGGTACATTAA<br>601 AGTCTATTTTATTTTAAAAAAAAA | SEQ ID NO: 76 |
| BM734661 | Human UbA52 adrenal mRNA for ubiquitin-52 amino acid fusion protein. | 1 GACGCGAGACATGCAGATCTTTGTGAAGACCCTGACGGGCAAGACCATCACCCTCGAGGTT<br>61 GAGCCCAGTGACACCATTGAGAATGTTAAAGCTAAAATCCAAGACAAGGAGGGCATCCCA<br>121 CCTGACCAGCAGCGTTTGATTTTTGCCGGCAAACAGCTGGAGGACGGCCGCACTCTCTCA<br>181 GACTACAATATCCAGAAAGAGTCCACCCTGCACTTGGTGCTCCGCCTGCGGGGCGGCATC<br>241 ATTGAGCCTTCCCTCCGCCAGCTCGCCCAGAAATACAACTGCGACAAGATGATTTGCCGC<br>301 AAGTGTTATGCTCGCCTGCACCCTCGTGCTGTCAACTGCCGCAAGAAGAAGTGCGGCCAC<br>361 ACCAACAACCTGCGCCCCAAGAAGAAGGTCAAATAAGGTTGTTCTTTCCTTGAAGGGCAG<br>421 CCTCCTGCCCAGGCCCCATGGCCCTGGGGCCTCAATAAAGTTTCCCTTTCATTGACTGGA<br>481 AAAAAAAAAAAAAAA | SEQ ID NO: 77 |
| | | 1 M Q I F V K T L T G K T I T L E V E P S<br>1 ATGCAGATCTTTGTGAAGACCCTGACGGGCAAGACCATCACCCTCGAGGTTGAGCCCAGT<br>21 D T I E N V K A K I Q D K E G I P P D Q<br>61 GACACCATTGAGAATGTTAAAGCTAAAATCCAAGACAAGGAGGGCATCCCACCTGACCAG<br>41 Q R L I F A G K Q L E D G R T L S D Y N<br>121 CAGCGTTTGATTTTTGCCGGCAAACAGCTGGAGGACGGCCGCACTCTCTCAGACTACAAT<br>61 I Q K E S T L H L V L R L R G G I I E P<br>181 ATCCAGAAAGAGTCCACCCTGCACTTGGTGCTCCGCCTGCGGGGCGGCATCATTGAGCCT<br>81 S L R Q L A Q K Y N C D K M I C R K C Y<br>241 TCCCTCCCCCAGCTCGCCCAGAAATACAACTGCGACAAGATGATTTGCCGCAAGTGTTAT<br>101 A R L H P R A V N C R K K C G H T N N<br>301 GCTCGCCTGCACCCTCGTGCTGTCAACTGCCGCAAGAAGAAGTGCGGCCACACCAACAAC<br>121 L R P K K V K -<br>361 CTGCGCCCCAAGAAGAAGGTCAAATAA | SEQ ID NO: 78 |
| WBC022G05 | Homo sapiens ELOVL family member 5, elongation of long chain fatty acids (FEN1/Elo2, SUR4/Elo3-like, yeast) (ELOVL5) | 1 CCAACCCCGGCCTAGGCTCTCCACCGCATCGGATTCTGGAATTTACGATCACGAAAGTTC<br>61 TATTGTCCCGCGATTGGCTCCCGGGCCGCATGACATCATAGCGCTTGATTCATCCTTCGG<br>121 GTCCCGATTGGCTGGCCGCGCCCATTGTGACGTCACGGTCAGCCCACGTTCTGATTGTAGA<br>181 TAGCCGGCGCCTTCCTCTTCCCATCGCGCGGGTCCTAGCCACCGGTGTCTCCTTCTACAT<br>241 CCGCCTCTGCGCCGGCTGCCACCCGCGCTCCCTCCGCCGCCGCCGCCTTGCTGCTCCTCA<br>301 AAGCTGCTGCCGCCCCTTGGGCTAAAAGGTTTTCAAATGGAACATTTTGATGCATCACTT<br>361 AGTACCTATTTCAAGGCATTGCTAGGCCCTCGAGATACTAGAGTAAAAGGAGTGGTTCTT<br>421 CTGGACAATTATATACCCACATTTATCTGCTCTGTCATATATTTACTAATTGTATGGCTG<br>481 GGACCAAAATCATGAGGAATAAACAGCCATTCTCTTGCCGGGGCATTTTAGTGGTGTAT<br>541 AACCTTGGACTCACACTGCTGTCTCTGTATATGTTCTGTGAGTTAGTAACAGGAGTATGG<br>601 GAAGGCAAATACAACTTCTTCTGTCAGGGCACACGCACCGCAGGAGAATCAGATATGAAG<br>661 ATTATCCGTGTCCTCTGGTGGTACTACTTCTCCAAACTCATAGAATTTATGGACACTTTC<br>721 TTCTTCATCCTGCGCAAGAACAACCACCAGATCACGGTCCTGCACGTCTACCACCATGCC<br>781 TCGATGCTGAACATCTGGTGGTTTGTGATGAACTGGGTCCCCTGCGCCACTCTTATTTT<br>841 GGTGCACACTTAATAGCTTCATCCACGTCCTCATGTACTCTTACTAGTTGTTCGTCA<br>901 GTCCCTTCCATGCGTCCATACCTCTGGTGGAAGAAGTACATCACTCAGGGGCAGCTGCTT<br>961 CAGTTTGTGCTGACAATCATCCAGACCAGCTGCGGGTCATCTGGCCGTGCACATTCCCT<br>1021 CTTGGTTGGTTGTATTTCCAGATTGGATACATGATTTCCCTGATTGCTCTCTTCACAAAC<br>1081 TTCTACATTCAGACCTACAACAAGAAAGGGGCCTCCCGAAGGAAAGACCACCTGAAGGAC<br>1141 CACCAGAATGGGTCCATGGCTGCTGTGAATGGACACACCAACAGCTTTTCACCCCTGGAA | SEQ ID NO: 79 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 1201 AACAATGTGAAGCCAAGGAAGCTGCGGAAGGATTGAAGTCAAAGAATTGAAACCCTCCAA<br>1261 ACCACGTCATCTGATTGTAAGCACAATATGAGTTGTGCCCCAATGCTCGTAAACAGCTGC<br>1321 TGTAACTAGTCTGGCCTACAATAGTGTGATTCATGTAGGACTTCTTTCATCAATTCAAAA<br>1381 CCCCTAGAAAACGTATACAGATTATATAAGTAGGGATAAGATTTCTAACATTTCTGCGCT<br>1441 CTCTGACCCCTGCGCTAGACTGTGGAAAGGGAGTATTATTATAGTATACAACACTGCTGT<br>1501 TGCCTTATTAGTTATAACATGATAGGTGCTGAATTGTGATTCACAATTTAAAAACACTGT<br>1561 AATCCAAACTTTTTTTTTTAACTGTAGATCATGCATGTGATTGTAAATGTAAATTTGTAC<br>1621 AATGTTGTTATGGTAGAGAAACACACATGCCTTAAAATTTAAAAAGCAGGGCCCAAAGCT<br>1681 TATTAGTTTAAATTAGGGTATGTTTCAAGTTTGTATTAATTTGTAAAGCAACTGTTTAGA<br>1741 AAAAATCAAAGACCATGATTTATGAAACTAATGTGACATAATTTCCAGTGACTTGTTGAT<br>1801 GTGAATCAGACACGGCACCAATCAGTTTTGTACTATTGGCTTTGAATCAAGCAGGCTCAA<br>1861 ATCTAGTGGAACAGTCAGTTTAACTTTTTAACAGATCTTATTTTTTTATTTTGAGTGCCA<br>1921 CTATTAATGTAAAAGGGGGGGCTCTACAGCAGTCGTGATGAAACTTAAATATATATTC<br>1981 TTTGTCCTCGAGATTTTAGGAAGGGTGTAGGGTGAGTAGGCCATTTTTAATTTCTGAAGT<br>2041 GCTAAGTGTTTTTATACAGCAAACAAAAAGTCAATTTTGCTTTCCACCAGTGCGAGAGAG<br>2101 GATGTATACTTTTCAAGAGAGATGATTGCCTATTTACCGTTTGACAGAGTCCCGTAGATG<br>2161 AGCAATGGGGAACTGGTTGCCAGGGTCTAAATTTGGATTGATTTATGCACTGTTATCTGT<br>2221 TTTGACACAGATTTCCTTGTAAAATGTGCCTAGTTTACCAAAATTAACAAAGGGGGGGAA<br>2281 AGGACCTTAGAACTTTTTAAGGTAAAATCAAATATAGCTACAGCATAAGAGAATCGAGAA<br>2341 ATTTGATAGAGGTAACTTGTTTAATGTAAATCTAATAGTACTTGTAATTTCTTTCTGCTT<br>2401 AGAATCTAAAGATGTGTTTAGAACCTCTTGTTTAAAAATAATAGACTGCTTATCATAAAA<br>2461 TCACATCTCACACATTTGAGGCAGTGGTCAAACAGGTAAAGCCTATGATGTGTGTCATTT<br>2521 TAAAGTGTCGGAATTTAGCCTCTGAATACTTCTCCATTGGGGGAAAGATATTCTTGGAA<br>2581 CCACTCATGACATATCTTAGAAGGTCATTGACAATGTATAAACTAATTGTTGGTTTGATA<br>2641 TTTATGTAAATATCAGTTTACCATGCTTTAATTTTGCACATTCGTACTATAGGGAGCCTA<br>2701 TTGGTTCTCTATTAGTCTTGTGGGTTTTCTGTTTGAAAAGGAGTCATGGCATCTGTTTAC<br>2761 ATTTACCTTATCAAACCTAGAATGTGTATATTTATAAATGTATGTCTTCATTGCTAGGTA<br>2821 CTAATTTGCAGATGTCTTTACATATTTCAATACAGAAACTATAACATTCAATAGTGTGCT<br>2881 GTCAAAGTGTGCTTAGCTCACCTGGATATACCTACATTGTTAAATGTCTAAACAGTAATC<br>2941 ATTAAAACATTTTTGATTACCTGTGAAAAAAAAAAAAAAAAAAAAAAAAAAAAAAA<br>3001 AAA | |
| | | 1 MEHFDASLSTYFKALLGPRDTRVKGWFLLDNYIPTFICSVIYLLIVWLGPKYMRNKQPFS<br>61 CRGILVVYNLGLTLLSLYMFCELVTGVWEGKYNFFCQGTRTAGESDMKIIRVLWWYYFSK<br>121 LIEFMDTFFFILRKNNHQITVLHVYHHASMLNIWWFVMNWVPCGHSYFGATLNSFIHVLM<br>181 YSYYGLSSVPSMRPYLWWKKYITQGQLLQFVLTIIQTSCGVIWPCTFPLGWLYFQIGYMI<br>241 SLIALFTNFYIQTYNKKGASPRKDHLKDHQNGSMAAVNGHTNSFSPLENNVKPRKLRKD- | SEQ ID NO: 80 |
| WBC032G11_V1.3_AT | Homo sapiens cDNA FLJ20073 fis, clone C0L02320. | 1 AAAATTTGAAGACAAGATGGGCACCTACTCTACAATTCTGATAAAACAGAGGTCATCGA<br>61 ATGTGGGGAACTACTGTGGAGTACGCATCATTCACTCTTTGATTGCAGAGTTCTCACTGA<br>121 AGAATTGAAGAAAAGCTATCACCTGAATAAAAGTCAAATTATGTTGGATATGTCTAACTGA<br>181 GAATTTGTTCTTCGATACTGGTATGGGAAAAGTAAATTTTTGCAAGATATGCACACACT<br>241 CCTACTCACAAGACACCGCGATGAACATGAAGGTGAAACAGGAAATTGGTTTTCCCCATT<br>301 TATTGAAGCATTACATAAAGATGAAGGAAATGAAGCAGTTGAAGCTGTATTGCTTGAAAG<br>361 TATCCATCGGTTCAACCCAAATTGCATTCATTTGCCAAGCGTTGGCAAGACATTTCTACAT<br>421 TAAAAAGAAGGACTTTGGCAATGCTCTAAACTGGGCAAAACAAGCAAAAATCATAGAACC<br>481 TGACAATTCTTATATCTCAGATACACTGGGTCAAGTCTACAAAAGTAAAATAAGATGGTG<br>541 GATAGAGGAAAACGGAGGAAACGGGAACATTTCAGTTGATGATCTAATTGCTCTTTTGGA<br>601 TTTAGCAGAACATGCCTCAAGTGCATTCAAAGAATCTCAACAGCAAAGTGAAGATAGAGA<br>661 GTATGAAGTGAAGGAAAGATTGTATCCGAAGTCAAAAAGGCGGTATGATACTTACAATAT<br>721 AGCTGGTTATCAAGGAGAGATAGAGTTGGGCTAATACACAATCCAAATTCTCCAGCTCAT<br>781 TCCTTTTTTTGATAATAAAAATGAGCTATCTAAAAGATATATGGTCAATTTTGTATCAGG<br>841 AAGTAGTGATATTCCAGGGGATCCAAACAATGAATAAAATTAGCCCTCAAAAACTATAT<br>901 TCCTTATTTAACTAAATTGAAATTTTCTTTGAAAAAGTCCTTTGATTTTTTGATGAATA<br>961 CTTTGTCCTGCTAAAACCCAGGAACAATATTAAGCAAATGAAGAGGCCAAAACTCGGAG<br>1021 AAAGGTGGCTGGATATTTTAAGAAATATGTAGATATTTATTTGTCTCTTAGAAGAATCACA<br>1081 AAACAACACAGGTCTTGGATCAAAGTTCAGTGAGCCACTTCAAGTAGAGAGATGCAGGAG<br>1141 AAACCTAGTAGCTTTAAAAGCAGACAAGTTTTCTGGGCTCTTGGAATATCTTATCAAAAG<br>1201 TCAAGAGGATGCTATAAGCACTATGAAATGTATAGTGAACGAATATACTTTTCTCTTAGA<br>1261 ACAATGCACTGTCAAATCCAGTCAAAAGAAAAGCTAAATTTCATCTTGGCCAACATTAT<br>1321 TCTCTCCTGTATCCAACCTACCTCCAGATTAGTAAAGCCAGTTGAAAAACTAAAAGATCA<br>1381 GCTTCGAGAAGTCTTGCAACCAATAGGACTGACTTATCAGTTTTCAGAACCGTATTTTCT<br>1441 AGCTTCCCTCTTATTCTGGCCAGAAAATCAACAACTAGATCAACATTCTGAACAAATGAA<br>1501 AGAGTATGCTCAAGCACTAAAAAATTCTTTCAAGGGGCAATATAAACATATGCATCGTAC<br>1561 AACAACCAATTGCATATTTCTTTCTTCTTGGAAAAGGTAAAAGACTGGAAAGACTTGTTCA<br>1621 CAAAGGAAAATTGACCAGTGCTTTAAGAAGACACCAGATATTAATTCCTTGTGGCAGAG<br>1681 TGGAGATGTGTGGAAGGAGGAAAAAGTCCAAGAACTTTTGCTTCGTTTACAAGGTCGAGC<br>1741 TGAAAACAATTGTTTATATATAGAATATGGAATCAATGAAAAAATCACAATACCCATCAC<br>1801 TCCCGCTTTTTAGGTCAACTTAGAGGTGCAGAAGCATAGAGAAGGTGTCTTTTACCT<br>1861 GGGATTTCCCATTGGAGGCCCACTTGCTTATGACATTGAAATTGTTTAAGAGCCTGATAT<br>1921 TCTTCCTCCAAGAATTTGATCTCAGTACCCATTTAATTTTTTGGACTCAAGATCTATGC<br>1981 TTTAAACCGGCAAGGTTATAGATACAGCCTCTAGCTCTTCAGATCTGTACATGCAGTATT<br>2041 TAATTTCCTCTTAAACATGTTATGAGTTCTACAAGGACAATAGTGAAAAGGAAGGAGTG<br>2101 AGATATATGAAAAGTAGCAAATATGTTCCTTGGTTTGGTTAACATCATTGATGACAAAAT | SEQ ID NO: 81 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 2161 AATAAGGAGCTATGACTGGAGTCAGGAGAAGTTAGTGTAATAAGCTGGCTACACAGAACC<br>2221 CCACTACTTACCAGGCATGGATTGAAGAAGATTGTCTACTCAAATGGCATTTAGACATTA<br>2281 GAATGTCTGGGAAAATATTTCTCAAAGACAGCAAAAACCTCTCAAACTGAGGAGCAACAT<br>2341 TTATTCTTACTAAGCAGATCATCAATGTATCATGTGCTTGGCACTCAAGGATCTTCCAAA<br>2401 ACAGAGGACCAACCAGTCTTCTGAAGGTCATGCCCACAGAAGTCATCGGACCTTACCAAA<br>2461 GTAGGTTGGAGAATTAGATTGCCTTTTCATGCAGTGAGATTCAGTTAAGCAAAAATGAAA<br>2521 TTTGTCTCTATAGCTAATTAGCTTATCAACTCCCCTCCAAACAAACAATTAAAAAAAAAA<br>2581 CATACAGACACTCAAATTCCACAAGCTAATGAATAAAAAGGATTCCTGTGAAAAGGCTAA<br>2641 TGAGTCACCCATCCAGGAGATCCCAACGTACTAGCAAGTATACATATAACCTACACACTG<br>2701 AACAAGCACAATCACTGAGATGTAATCAAAATGTAATTTTCCCTAATAAAATTATGGATA<br>2761 TGGGCAATTGTCAATGGTTGCCAAAACCATTAAGTGGAAAGCTGATTAAAAAACAAAAAT<br>2821 TTCTAATGGATTTATCAGACTGTCCTAAATCCTGATCAATATTAACACTGCAGAGAGACA<br>2881 GCCAGACATTGTGGGCCTCGAAGTGCTACAGGAGTGCACACATCACCTGGAGATAGTCTT<br>2941 GCCAAATAATTGAACCTGAATCTGATCAAGCCTCTGGATCTTATTTGCAATTCAAAAGAA<br>3001 ATTTTAAAAAAATCCTACTAACACCACCACAAATATGCAATCAGCAATATCCAGAAAGGG<br>3061 GAAATTCACAGGACAAAAACCTGGTTTTCTTTTTGGTTTCTTCAACCAAAAAGAAAGA<br>3121 AATTGCAAAGGACCAAAAAAATGTTGGGGAATCTATACATTATAAGGGACTTAACAACTA<br>3181 AAGGGCAACATATAGACTTTAGATCCTAATTTGAGCAAAATCTAAATCAATTATTAGGC<br>3241 AATCAGAAAAATTTGAACACAGACTAGATATTTGAGGTATTAAGGTACTATATATTGA<br>3301 AGATTCCATGGTTATGTTTTTTAAAGAGTTCATGCCTTTTAGAGATACATACTAAAGTAT<br>3361 TTGTAAATAAATGACATGATCTAGAAAAAAAAAAAAAAA | |
| | |   1 M  G  T  Y  S  T  I  L  I  K  T  E  V  I  E  C  G  N  Y  C<br>   1 ATGGGCACCTACTCTACAATTCTGATAAAAACAGAGGTCATCGAATGTGGGAACTACTGT | SEQ ID NO: 82 |
| | |  21 G  V  R  I  I  H  S  L  I  A  E  F  S  L  E  E  L  K  K  S<br>  61 GGAGTACGCATCATTCACTCTTTGATTGCAGAGTTCTCACTGGAAGAATTGAAGAAAAGC | |
| | |  41 Y  H  L  N  K  S  Q  I  M  L  D  M  L  T  E  N  L  F  F  D<br> 121 TATCACCTGAATAAAAGTCAAATTATGTTGGATATGCTAACTGAGAATTTGTTCTTCGAT | |
| | |  61 T  G  M  G  K  S  K  F  L  Q  D  M  H  T  L  L  L  T  R  H<br> 181 ACTGGTATGGGAAAAAGTAAATTTTTGCAAGATATGCACACACTCCTACTCACAAGACAC | |
| | |  81 R  D  E  H  E  G  E  T  G  N  W  F  S  P  I  E  A  L  H<br> 241 CGCGATGAACATGAAGGTGAAACAGCAAATTGGTTTTCCCCATTTATTGAAGCATTACAT | |
| | | 101 K  D  E  G  N  E  A  V  E  A  V  L  L  E  S  I  H  R  F  N<br> 301 AAAGATGAAGGAAATGAAGCAGTTGAAGCTGTATTGCTTGAAAGTATCCATCGGTTCAAC | |
| | | 121 P  N  A  F  I  C  Q  A  L  A  R  H  F  Y  I  K  K  K  D  F<br> 361 CCAAATGCATTCATTTGCCAAGCGTTGGCAAGACATTTCTACATTAAAAAGAAGGACTTT | |
| | | 141 G  N  A  L  N  W  A  K  Q  A  K  I  I  E  P  D  N  S  Y  I<br> 421 GGCAATGCTCTAAACTGGGCAAAACAAGCAAAAATCATAGAACCTGACAATTCTTATATC | |
| | | 161 S  D  T  T  G  Q  V  Y  K  S  K  I  R  W  W  I  E  E  N  G<br> 481 TCAGATACACTGGGTCAAGTCTACAAAAGTAAAATAAGATGGTGGATAGAGGAAAACGGA | |
| | | 181 G  N  G  N  I  S  V  D  D  L  I  A  L  L  D  L  A  E  H  A<br> 541 GGAAACGGGAACATTTCAGTTGATGATCTAATTGCTCTTTTGGATTTAGCAGAACATGCC | |
| | | 201 S  S  A  F  K  E  S  Q  Q  Q  S  E  D  R  E  Y  E  V  K  E<br> 601 TCAAGTGCATTCAAAGAATCTCAACAGCAAAGTGAAGATAGAGAGTATGAAGTGAAGGAA | |
| | | 221 R  L  Y  P  K  S  K  R  R  Y  D  T  Y  N  I  A  G  Y  Q  G<br> 661 AGATTGTATCCGAAGTCAAAAAGGCGGTATGATACTTACAATATAGCTGGTTATCAAGGA | |
| | | 241 E  I  E  V  G  L  Y  T  I  Q  I  L  Q  L  I  P  F  F  D  N<br> 721 GAGATAGAAGTTGGGCTTTACACAATCCAAATTCTCCAGCTCATTCCTTTTTTTGATAAT | |
| | | 261 K  N  E  L  S  K  R  Y  M  V  N  F  V  S  G  S  S  D  I  P<br> 781 AAAAATGAGCTATCTAAAAGATATATGGTCAATTTTGTATCAGGAAGTAGTGATATTCCA | |
| | | 281 G  D  P  N  N  E  Y  K  L  A  L  K  N  Y  I  P  Y  L  T  K<br> 841 GGGGATCCAAACAATGAATATAAATTAGCCCTCAAAAACTATATTCCTTATTTAACTAAA | |
| | | 301 L  K  F  S  L  K  K  S  F  D  F  F  D  E  Y  F  V  L  L  K<br> 901 TTGAAATTTTCTTTGAAAAAGTCCTTTGATTTTTTTGATGAATACTTTGTCCTGCTAAAA | |
| | | 321 P  R  N  N  I  K  Q  N  E  E  A  K  T  R  R  K  V  A  G  Y<br> 961 CCCAGGAACAATATTAAGCAAAATGAAGAGGCCAAAACTCGGAGAAAGGTGGCTGGATAT | |
| | | 341 F  K  K  Y  V  D  I  F  C  L  L  E  E  S  Q  N  N  T  G  L<br>1021 TTTAAGAAATATGTAGATATATTTGTCTCTTAGAAGAATCACAAAACAACACAGGTCTT | |
| | | 361 G  S  K  F  S  E  P  L  Q  V  E  R  C  R  R  N  L  V  A  L<br>1081 GGATCAAAGTTCAGTGAGCCACTTCAAGTAGAGAGATGCAGGAGAAACCTAGTAGCTTTA | |
| | | 381 K  A  D  K  F  S  G  L  L  E  Y  L  I  K  S  Q  E  D  A  I<br>1141 AAAGCAGACAAGTTTTCTGGGCTCTTGGAATATCTTATCAAAGTCAAGAGGATGCTATA | |
| | | 401 S  T  M  K  C  I  V  N  E  Y  T  F  L  L  E  Q  C  T  V  K<br>1201 AGCACTATGAAATGTATAGTGAACGAATATACTTTTCTCTTAGAACAATGCACTGTCAAA | |
| | | 421 I  Q  S  K  E  K  L  N  F  I  L  A  N  I  I  L  S  C  I  Q<br>1261 ATCCAGTCAAAAGAAAAGCTAAATTTCATCTTGGCCAACATTATTCTCTCCTGTATCCAA | |
| | | 441 P  T  S  R  L  V  K  P  V  E  K  L  K  D  Q  L  R  E  V  L<br>1321 CCTACCTCCAGATTAGTAAAGCCAGTTGAAAAACTAAAGATCAGCTTGAGAAGTCTTG | |
| | | 461 Q  P  I  G  L  T  Y  Q  F  S  E  P  Y  F  L  A  S  L  L  F<br>1381 CAACCAATAGGACTGACTTATCAGTTTTCAGAACCGTATTTTCTAGCTTCCCTCTTATTC | |
| | | 481 W  P  E  N  Q  Q  L  D  Q  H  S  E  Q  M  K  E  Y  A  Q  A<br>1441 TGGCCAGAAAATCAACAACTAGATCAACATTCTGAACAAATGAAAGAGTATGCTCAAGCA | |
| | | 501 L  K  N  S  F  K  G  Q  Y  K  H  M  H  R  T  K  Q  P  I  A<br>1501 CTAAAAAATTCTTTCAAGGGGCAATATAAACATATGCATCGTACAGCAACCAAAATTGCA | |

TABLE 1-continued

| Gene | GenBank Homology | DNA SEQUENCE/DEDUCED AMINO ACID SEQUENCE | SEQUENCE IDENTIFIER: |
|---|---|---|---|
| | | 521 Y F F L G K G K R L E R L V H K G K I D<br>1561 TATTTCTTTCTTGGAAAAGGTAAAAGACTGGAAAGACTTGTTCACAAAGGAAAAATTGAC<br>541 Q C F K K T P D I N S L W Q S G D V W K<br>1621 CAGTGCTTTAAGAAGACACCAGATATTAATTCCTTGTGGCAGAGTGGAGATGTGTGGAAG<br>561 E E K V Q E L L L R L Q G R A E N N C L<br>1681 GAGGAAAAAGTCCAAGAACTTTGCTTCGTTTACAAGGTCGAGCTGAAAACAATTGTTTA<br>581 Y I E Y G I N E K I T I P I T P A F L G<br>1741 TATATAGAATATGGAATCAATGAAAAAATCACAATACCCATCACTCCCGCTTTTTTAGGT<br>601 Q L R S G R S I E K V S F Y L G F P I G<br>1801 CAACTTACAAGTCGCAGAACCATAGACAAGGTGTCTTTTTACCTGCCATTTCCCATTCGA<br>621 G P L A Y D I E I V -<br>1861 GGCCCACTTGCTTATGACATTGAAATTGTTTAA | |
| WBC028A02 | No homology | 1 CTCACACAGTAGCCATAGTGGTCTTTCTAAAGGCTTAATCAGAGTAGATCATTTCTTTGC<br>61 TTAAAACCTTTCAACGGTTTTCTGTTACGCTAAGAATAAAAACCCAAACTCTTAAGTATA<br>121 GCCAGCAAGGCCCCACTTCCCTGGCTGTCTCTCTGACTCCTTTGCGTCCTGCTTACTGTG<br>181 CTTCAGCCACGCTGGCTTCCTTGCTGCTGATCCTGCTTGATCACCAGCTTGATCCTGTCC<br>241 CGCTGGTGTACTCCAAGATAACTGGTCAGTTGGTCCTGTCCCAGGGGCTTTGTCCTTCTG<br>301 TCTTCTTTTTCAGTCTGCTTCCCCTAGATGCTCGCCAGCTGCTTCCTTTTCCCTGTTCTA<br>361 GTCTCAACTCAAAGGTCACTGTGCTAGAGAAGCTTTCTTCAGCCACCCAGCAGATCAGCA<br>421 CCCTCTTCATCACTGTCCACCACAGTGTCTTTCTCTGTCTTCCTCATGGCTCTCAAACTG<br>481 TCTTATTCGTTATTGATGGGTTTTTTTCATCTTTCTGTCCCCATTAACATATAAGCTTT<br>541 TTAAGAGCAGAGACTTTCTTTTCACCACGCCTAAAACAGGACCTACCACACATATTGAATGT<br>601 TGAACAGATATTTATTGACTGACTAGTAAAAATGCATCTTTGAACTTAAAATGAATGTGT<br>661 TTTGTGAAGTATGGCAAAAGCCAATTTGGGAGTATTTGTGCTTTAAATTTCAAAAGTTGC<br>721 AAATACAGGCTGTGTTGAAGGCATTTTAGGAATCAGACAGACTCTGGGAATTTAAATCGT<br>781 TGTTCTGC<br><br>NON CONTIGUOUS<br>1 AGTGTAGGAGTTCAGTAGGGATGTGTATTTTAATGTGCACCTATTTTAGGGCATTGACAT<br>61 ACAGAGTGAAGCAAGGTGGCCACCTATTTTATTGTGAGCTCTTCCTAGGAAGGCTCCTAT<br>121 TTCAGCAGTTTGGTCTGGCTAACTTTAAATGGAACAGCTAAGCTGACGTTGGCAGGCATT<br>181 CAAATTCATGTCTCCTTGGGGCCAATCTGTTCTATTTTGTGCCATGAAACTTCAGCTGTT<br>241 GAGCAAAGAGCAACTTAGCTGTCTCATCCCAAAAATCTAGAACAAGTCTAAAGATCTATG<br>301 CAGAAGAGTGGGAAGGTAAATTATGGTATCTCCTTAGGACAGAATTTATGAATTTATTG<br>361 AAAGATATAGGAAAGAAGCATTTAAGAAGTCTAGAGGAGGGGCTGGCCTTGTGGCATAGT<br>421 GGTTAAGTTTAGTGCACTCCCCTTCAGTGACCCGGGTTCACAGATTTGGATCCTGGATGC<br>481 AGACCTAGGCCAGTCATCAGCCATGCTGATGACCCACATGCAAATAAAGGAAGATTGGCA<br>541 CAGATGTTAGCTCAGGGCTAATCTTCCTCAGCAAAAAAAAA | SEQ ID NO: 83<br><br><br><br><br><br><br><br><br><br><br><br><br><br><br><br><br>SEQ ID NO: 84 |
| WBC024E03_V1.3_AT | Homo sapiens transcription factor ISGF-3 mRNA. | 1 ATTAAACCTCTCGCCGAGCCCCTCCGCAGACTCTGCGCCGGAAAGTTTCATTTGCTGTAT<br>61 GCCATCCTGAGAGCTGTCTAGGTTAACGTTCGCACTCTGTGTATATAACCTCGACAGTC<br>121 TTGGCACCTAACGTGCTGTGCGTAGCTGCTCCTTTGGTTGAATCCCCAGGCCCTTGTTGG<br>181 GGCACAAGGTGGCAGGATGTCTCAGTGGTACGAACTTCAGCAGCTTGACTCAAAATTCCT<br>241 GGAGCAGGTTCACCAGCTTTATGATGACAGTTTTCCCATGGAAATCAGACAGTACCTGGC<br>301 ACAGTGGTTAGAAAAGCAAGACTGGGAGCACGCTGCCAATGATGTTTCATTTGCCACCAT<br>361 CCGTTTTCATGACCTCCTGTCACAGCTGGATGATCAATATAGTCGCTTTTCTTTGGAGAA<br>421 TAACTTCTTGCTACAGCATAACATAAGGAAAAGCAAGCGTAACTCTTCAGGATAATTTTCA<br>481 GGAAGACCCAATCCAGATGTCTATGATCATTTACAGCTGTCTGAAGGAAGAAAGGAAAAT<br>541 TCTGGAAAACGCCCAGAGATTTAATCAGGCTCAGTCGGGAATATTCAGAGCACAGTGAT<br>601 GTTAGACAAACAGAAAGAGCTTGACAGTAAAGTCAGAAATGTGAAGGACAAGGTTATGTG<br>661 TATAGAGCATGAAATCAAGAGCCTGGAAGATTTACAAGATGAATATGACTTCAAATGCAA<br>721 AACCTTGCAGAACAGAGAACACGAGACCAATGGTGTGGCAAAGAGTGATCAGAAACAAGA<br>781 ACAGCTGTTACTCAAGAAGATGTATTTAATGCTTGACAATAAGAGAAAGGAAGTAGTTCA<br>841 CAAAATAATAGAGTTGCTGAATGTCACTGAACTTACCCAGAATGCCCTGATTAATGATGA<br>901 ACTAGTGGAGTGGAAGCGGAGACAGCAGAGCGCCTGTATTGGGGGCGCCCCAATGCTTG<br>961 CTTGGATCAGCTGCAGAACTGGTTCACTATAGTTGCGGAGAGTCTGCAGCAAGTTCGGCA<br>1021 GCAGCTTAAAAAGTTGGAGGAATTGGAACAGAAATACACCTACGAACATGACCCTATCAC<br>1081 AAAAAACAAACAAGTGTTATGGGACCGCACCTTCAGTCTTTTCCAGCAGCTCATTCAGAG<br>1141 CTCGTTTGTGGTGGAAAGACAGCCCTGCATGCCAACGCACCCTCAGAGGCCGCTGGTCTT<br>1201 GAAGACAGGGGTCCAGTTCACTGTGAAGTTGAGACTGTTGGTGAAATTGCAAGAGCTGAA<br>1261 TTATAATTTGAAAGTCAAAGTCTTATTTGATAAAGATGTGAATGAGAGAAATACAGTAAA<br>1321 AGGATTTAGGAAGTTCAACATTTTGGGCACGCACACAAAAGTGATGAACATGGAGGAGTC<br>1381 CACCAATGGCAGTCTGGCGGCTGAATTTCGGCACCTGCAATTGAAAGAACAGAAAAATGC<br>1441 TGGCACCAGAACGAATGAGGGTCCTCTCATCGTTACTGAAGAGCTTCACTCCCTTAGTTT<br>1501 TGAAACCCAATTGTGCCAGCCTGGTTTGGTAATTGACCTCGAGACGACCTCTCTGCCCGT<br>1561 TGTGGTGATCTCCAACGTCAGCCAGCTCCCGAGCGGTTGGGCCTCCATCCTTTGGTACAA<br>1621 CATGCTGGTGGCGGAACCCAGGAATCTGTCCTCTTCCTGACTCCACCATGTGCACGATG<br>1681 GGCTCAGCTTTCAGAAGTGCTGAGTTGGCAGTTTTCTTCTGTCACCAAAGAGGTCTCAA<br>1741 TGTGGACCAGCTGAACATGTTGGGAGAGAAGCTTCTTGGTCCTAACGCCAGCCCCGATGG<br>1801 TCTCATTCCGTGGACGAGGTTTTGTAAGGAAAATATAAATGATAAAATTTTCCCTTCTG<br>1861 GCTTTGGATTGAAAGCATCCTAGAACTCATTAAAAAACACCTGCTCCCTCTCTGGAATGA<br>1921 TGGGTGCATCATGGGCTTCATCAGCAAGGAGCGAGAGCGTGCCCTGTTGAAGGACCAGCA<br>1981 GCCGGGGACCTTCCTGCTGCGGTTCAGTGAGAGCTCCCGGGAAGGGGCCATCACGTTCAC | SEQ ID NO: 85 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 2041 GTGGGTGGAGCGCTCCCAGAACGGAGGAGAGCCTTACTTTCATGCGGTCGAACCCTACAC<br>2101 GAAGAAGAACTTTCTGCTGTTACTTTTCCAAGATATCATTCGCAATTACAAAGTCATGGC<br>2161 TGCTGAAAATATTCCAGAGAATCCCCTGAAGTATCTGTATCCAAATATTGATAAGGACCA<br>2221 TGCCTTCGGAAAGTATTACTCCAGGCCCAAGGAAGCTCCAGAACCAATGGAACTTGATGG<br>2281 CCCTAAAGGAACTGGATACATCAAGACTGAATTGATTTCTGTGTCTGAAGTTCACCCTTC<br>2341 TCGACTTCAGACTACAGACAACCTTCTTCCCATGTCTCCTGAGGAGTTTGACGAGGTGTC<br>2401 TCGCATAGTGGGCTCTGTGGAATTCGACATGATGAACGCAGTATAGAGCATGAATTTTAC<br>2461 TCATCTTCCCTGGCGACATTTTTCCCTCCCATCTGTGATTCCCTCCTGCTGGTCTGTTCC<br>2521 TTCACATCCTGTGTTTCTAGGGAAAGGAAAGCAAGGCTGACAAATTTGCTGCAACCTGTT<br>2581 GATAGCAAGTGGATTTTTCCCTCATTCAGAAACATCTGTTACTCTGAAGGGCTTCATGCA<br>2641 TCTTATTAAAGGTAAAATTGAGAGACCTCTCCACAGAGTGGGTTTGACAAACGAACAAC<br>2701 ATTCAGATACACCCACAACCTCAGGACTAGAGTGCGAGTCCCTCGGGAAAGGGGAGAAGT<br>2761 CGAGCAGCGTGTGGCAAATACTATGCATAAAGTCAGTGCCCAACGGTTATGGGTTGTTGG<br>2821 ATAAATCAGTGGTTATTTAGGGAACTGCTTGACGTAGGAACGGTAAATTTCTGTGGGAGA<br>2881 ATTCTTACATGTTTTCTTTGCTTTAAGTGTAACTGGCAGTTTTCCATTGGTTTACCTGTG<br>2941 AAATAGTTCAAAGCCAAGTTTATATACAATTATATCAGTCCTCTTTCAAAGGTAGCCATC<br>3001 ATGGATCTGGTAGGGGGAAAATGTGTATTTTATTACATCTTTCACATTGGCTATTTAAAG<br>3061 ACAAAGACAAATTCTGTTTCTTGAGAGAGAATATTAGCTTTTCTGTTTGTTATGGGTTT<br>3121 ATGATACTGGCTAATATCAATAGAAGGAAGTACCTTTTCCAAATTCACAAGTTGTGTTTG<br>3181 ATATCCAAAGCTGAATACATTCTGCTTTCATCTTGGTCACATACAATTATTTTTACAGTT<br>3241 CTCCCAAGGGAGTTAGGCTATTCACAACCACTCATTCAAAAAGTTGAAATTAATCATAGA<br>3301 TGTAGACAAACTCAAATCTAATTCATGTTTTTTAAATGGGTTAATTTGTCTTTATTGTTA<br>3361 TTAGCTGGTATTTAGTCTATTAGCCACAAAATTGGGAAAGGAGTAGAAAAAGCAGTAACT<br>3421 GACAACTTGAATAATACACCAGAGATAATATGAGAATCAGATCATTTCAAAACTCATTTC<br>3481 CTATGTAACTGCATTAAGAATTGCATATTTTTCACTGATAAATGTGTTTTTCACATTTGC<br>3541 GAATGGTTCCATTCTCTCCTGTACTTTTTCCAGACACTTTTTTGAGTGGATGATGTTT<br>3601 CGTGAAGTATACTGTATTTTTACCTTTTTCCTTCCTTATCACTGACACAAAAAGTAGATT<br>3661 AAGAGATGGGTTTGACAAGGTTCTTCCCTTTTACATACTGCTGTCTATGTGGCTGTATCT<br>3721 TGTTTTTCCACTACTGCTACCACAACTATATTATCATGCAAATGCTGTATTCTTCTTTGG<br>3781 TGGAGATAAAGATTTCTTGAGTTTTGTTTTAAAATTAAAGCTAAAGTATCTGTATTGCAT<br>3841 TAAATATAATATCGACACAGTGCTTTCCGTGGCACTGCATACAATCTGAGGCCTCCTCTC<br>3901 TCAGTTTTTATATAGATGGCGAGAACCTAAGTTTCAGTTGATTTTACAATTGAAATGACT<br>3961 AAAAAACAAAGAAGACAACATTAAAAACAATATTGTTCTA | |
| | | 1 M S Q W Y E L Q Q L D S K F L E Q V H Q<br>1 ATGTCTCAGTGGTACGAACTTCAGCAGCTTGACTCAAAATTCCTGGAGCAGGTTCACCAG<br>21 L Y D D S F P M E I R Q Y L A Q W L E K<br>61 CTTTATGATGACAGTTTTCCCATGGAAATCAGACAGTACCTGGCACAGTGGTTAGAAAAG<br>41 Q D W E H A A N D V S F A T I R F H D L<br>121 CAAGACTGGGAGCACGCTGCCAATGATGTTTCATTTGCCACCATCCGTTTTCATGACCTC<br>61 L S Q L D D Q Y S R F S L E N N F L L Q<br>181 CTGTCACAGCTGGATGATCAATATAGTCGCTTTTCTTTGGAGAATAACTTCTTGCTACAG<br>81 H N I R K S K R N L Q D N F Q E D P I Q<br>241 CATAACATAAGGAAAAGCAAGCGTAATCTTCAGGATAATTTTCAGGAAGACCCAATCCAG<br>101 M S M I I Y S C L K E E R K I L E N A Q<br>301 ATGTCTATGATCATTTACAGCTGTCTGAAGGAAGAAAGGAAATTCTGGAAAACGCCCAG<br>121 R F N Q A Q S G N I Q S T V M L D K Q K<br>361 AGATTTAATCAGGCTCAGTCGGGGAATATTCAGAGCACAGTGATGTTAGACAAACAGAAA<br>141 E L D S K V R N V K D K V M C I E H E I<br>421 GAGCTTGACAGTAAAGTCAGAAATGTGAAGGACAAGGTTATGTGTATAGAGCATGAAAAC<br>161 K S L E D L Q D E Y D F K C K T L Q N R<br>481 AAGAGCCTGGAAGATTTACAAGATGAATATGACTTCAAATGCAAAACCTTGCAGAACAGA<br>181 E H E T N G V A K S D Q K Q E Q L L L K<br>541 GAACACGAGACCAATGGTGTGGCAAAGAGTGATCAGAAACAAGAACAGCTGTTACTCAAG<br>201 K M Y L M L D N K R K E V V H K I I E L<br>601 AAGATGTATTTAATGCTTGACAATAAGAGAAAGGAAGTAGTTCACAAAATAATAGAGTTG<br>221 L N V T E L T Q N A L I N D E V E W K<br>661 CTGAATGTCACTGAACTTACCCAGAATGCCCTGATTAATGATGAACTAGTGGAGTGGAAG<br>241 R R Q Q S A C I G G P P N A C L D Q L Q<br>721 CGGAGACAGCAGAGCGCCTGTATTGGGGGCCGCCCAATGCTTGCTTGGATCAGCTGCAG<br>261 N W F T I V A E S L Q Q V R Q Q L K K L<br>781 AACTGGTTCACTATAGTTGCGGAGAGTCTGCAGCAAGTTCGGCAGCAGCTTAAAAAGTTG<br>281 E E L E Q K Y T Y E H D P I T K N K Q V<br>841 GAGGAATTGGAACAGAAATACACCTACGAACATGACCCTATCACAAAAAACAAACAAGTG<br>301 L W D R T F S L F Q Q L I Q S S F V V E<br>901 TTATGGGACCGCACCTTCAGTCTTTTCCAGCAGCTCATTCAGAGCTCGTTTGTGGTGGAA<br>321 R Q P C M P T H P Q R P L V L K T G V Q<br>961 AGACAGCCCTGCATGCCAACGCACCCTCAGAGGCCGCTGGTCTTGAAGCAGGGGTCCAG<br>341 F T V K L R L L V K L Q E L N Y N L K V<br>1021 TTCACTGTGAAGTTGAGACTGTTGGTGAAATTGCAAGAGCTGAATTATAATTTGAAAGTC<br>361 K V L F D K D V N E R N T V K G F R K F<br>1081 AAAGTCTTATTTGATAAAGATGTGAATGAGAGAAATACAGTAAAAGGATTTAGGAAGTTC<br>381 N I L G T H T K V M N M E E S T N G S L<br>1141 AACATTTTGGGCACGCACACAAAAGTGATGAACATGGAGGAGTCCACCAATGGCAGTCTG | SEQ ID NO: 86 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 401 A A E F R H L Q L K E Q K N A G T R T N<br>1201 GCGGCTGAATTCGGCACCTGCAATTGAAAGAACAGAAAAATGCTGGCACCAGAACGAAT<br>421 E G P L I V T E E L H S L S F E T Q L C<br>1261 GAGGGTCCTCTCATCGTTACTGAAGAGCTTCACTCCCTTAGTTTTGAAACCCAATTGTGC<br>441 Q P G L V I D L E T T S L P V V V I S N<br>1321 CAGCCTGGTTTGGTAATTGACCTCGAGACGACCTCTCTGCCCGTTGTGGTGATCTCCAAC<br>461 V S Q L P S G W A S I L W Y N M L V A E<br>1381 GTCAGCCAGCTCCCGAGCGGTTGGGCCTCCATCCTTTGGTACAACATGCTGGTGGCGGAA<br>481 P R N L S F F L T P P C A R W A Q L S E<br>1441 CCCAGGAATCTGTCCTTCTTCCTGACTCCACCATGTGCACGATGGGCTCAGCTTTCAGAA<br>501 V L S W Q F S S V T K K G L N V D Q L N<br>1501 GTGCTGAGTTGGCAGTTTTCTTCTGTCACCAAAGAGGTCTCAATGTGGACCAGCTGAAC<br>521 M L G E K L L G P N A S P D G L I P W T<br>1561 ATGTTGGGAGAGAAGCTTCTTGGTCCTAACGCCAGCCCCGATGGTCTCATTCCGTGGACG<br>541 R F C K E N I N D K N F P F W L W I E S<br>1621 AGGTTTTGTAACGAAAATATAAATGATAAAAATTTTCCCTTCTGGCTTTGGATTGAAAGC<br>561 I L E L I K K H L L P L W N D G C I M G<br>1681 ATCCTAGAACTCATTAAAAAACACCTGCTCCCTCTCTGGAATGATGGGTGCATCATGGGC<br>581 F I S K E R E R A L L K D Q Q P G T F L<br>1741 TTCATCAGCAACGAGCGAGAGCCTGCCCTGTTGAAGGACCAGCACCCGCGGACCTTCCTG<br>601 L R F S E S S R E G A I T F T W V E R S<br>1801 CTGCGGTTCAGTGAGAGCTCCCGGGAAGGGGCCATCACGTTCACGTGGGTGGAGCGCTCC<br>621 Q N G G E P Y T F H A V E P Y T K K E L S<br>1861 CAGAACGGAGGAGAGCCTTACTTTCATGCGGTCGAACCCTACACGAAGAAACAACTTTCT<br>641 A V T F P D I I R N Y K V M A A E N I P<br>1921 GCTGTTACTTTTCCTGATATCATTCGCAATTACAAAGTCATGGCTGCTGAAAATATTCCA<br>661 E N P L K Y L Y P N I D K D H A F G K Y<br>1981 GAGAATCCCCTGAAGTATCTGTATCCAAATATTGATAAGGACCATGCCTTCGGAAAGTAT<br>681 Y S R P K E A P E P M E L D G P K G T G<br>2041 TACTCCAGGCCCAAGGAAGCTCCAGAACCAATGGAACTTGATGGCCCTAAAGGAACTGGA<br>701 Y I K T E L I S V S E V H P S R L Q T T<br>2101 TACATCAAGACTGAATTGATTTCTGTCTGAAGTTCACCCTTCTCGACTTCAGACTACA<br>721 D N L L P M S P E E F D E V S R I V G S<br>2161 GACAACCTTCTTCCCATGTCTCCTGAGGAGTTTGACGAGGTGTCTCGCATAGTGGGCTCT<br>741 V E F D M M N A V -<br>2221 GTGGAATTCGACATGATGAACGCAGTATAG | |
| BM734607.V1.3_AT | H.sapiens mRNA for XIAP associated factor-1. | 1 ATGGAAGGAGACTTCTCGGTGTGCAGGAACTGTAAAAGACATGTAGTCTCTGCCAACTTC<br>61 ACCCTCCATGAGGCTTACTGCCTGCGGTTCCTGGTCCTGTGTCCGGAGTGTGAGGAGCCT<br>121 GTCCCCAAGGAAACCATGGAGGAGCACTGCAAGCTTGAGCACCAGGAGGTCGGGTGTGCA<br>181 ATGTGTCAGCAGAGCGTGCCGAAGCACTCGCTGGAGCTTCATGAGGCCACGGAATGCAGG<br>241 GACCGCCCCGTTGCCGTGTCAGTTCTGTGAGCTGGCCGTGCGCCTCAGTAAGGCAGAGATC<br>301 CATGAGTACCACTGTGGCAGCCGGACTCAGCTCTGCCCAGACTGCGACCAGCCCATCATG<br>361 CTCCGAGCGCTGGCCCAGCACAAGGACGTGTGTCAGGGCAAACAGGCCCAGCTTGGGAAA<br>421 GGGAAGGAAATTTCAGCTCCTGAATGCAAATTCAGCTGTTGGTATTGCAACGAAATGATT<br>481 CCAGGAGATAAGTATTCCCACCACGTGGATAAATGTCGCACAGTCTCAGAGTCTGTGAAA<br>541 TATTTTCCAGTTGGAAAGCCAAGAATTCCTCCTCCATCCCTTCCAAGCCAGGCTGCTGAA<br>601 GATCAATCTTCCACGGCAGAAAAGAAAGATGTCCGTCCAGACAAGAAGTATAAACAGATTT<br>661 CCTCTTCATTCTGAAAGTTCATCAAAGAAAGCACCAAGAAGCAAAAACAAAACCTTGGAT<br>721 CCACTTTTTGATGTCAGAGCCCAAGCCCAGGACCAGCTCCCCTAGAGGAGATAAAGCAGCC<br>781 TATGACATTCTGAGGAGATGTTCTCAGTGTGGCATCCTGCTTCCCCTGCCGATCCTAAAT<br>841 CAACATCAGGAGAAATGCCGGTGGTTAGCTTCATCAAAAAGGAAAACAAGTGAGAAATTT<br>901 CAGCTAGATTTGGAAAAGGAAAGGTACTACAAATTCAAAAGATTTCACTTTTAACACTGG<br>961 CATTCCTGCCTACTTGCTGTGGTGGTCTTGAGAAAGGTGATGGGTTTTATTCGTTGGGCT<br>1021 TTAAAAGAAAAGGTTTGGCAGAACTAAAAACAAAACTCACGTATCATCTCAATAGATACA<br>1081 GAAAAGGCTTTTGATAAAATTCAACTTGACTTCATGTTAAAAACCCTCAACAAACCAGGC<br>1141 GTCGAAGGAACATACCTCAAAATAATAAGAGCCATCTATGACAAAACACAGCCAACATC<br>1201 ATACKGAATGAGCAAAAGCTGGAGCATTACTCTTGAGAAGTAGAACAAGGCACTTCAGTC<br>1261 CTATTCAACATAGTACTGGAAGTCTCGCCACAGCAATCAGGCAAGAGAAAGAAGTAAAAG<br>1321 GCACCC | SEQ ID NO: 87 |
| | | 1 M E G D F S V C R N C K R H V V S A N F<br>1 ATGGAAGGAGACTTCTCGGTGTGCAGGAACTGTAAAAGACATGTAGTCTCTGCCAACTTC<br>21 T L H E A Y C L R F L V L C P E C E E P<br>61 ACCCTCCATGAGGCTTACTGCCTGCGGTTCCTGGTCCTGTGTCCGGAGTGTGAGGAGCCT<br>41 V P K E T M E E H C K L E H Q E V G C A<br>121 GTCCCCAAGGAAACCATGGAGGAGCACTGCAAGCTTGAGCACCAGGAGGTCGGGTGTGCA<br>61 M C Q Q S V P K H S L E L H E A T E C R<br>181 ATGTGTCAGCAGAGCGTGCCGAAGCACTCGCTGGAGCTTCATGAGGCCACGGAATGCAGG<br>81 D R P V A C Q F C E L A V R L S K A E I<br>241 GACCGCCCCGTTGCCGTGTCAGTTCTGTGAGCTGGCCGTGCGCCTCAGTAAGGCAGAGATC<br>101 H E Y H C G S R T Q L C P D C D Q P I M<br>301 CATGAGTACCACTGTGGCAGCCGGACTCAGCTCTGCCCAGACTGCGACCAGCCCATCATG | SEQ ID NO: 88 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 121 L R A L A Q H K D V C Q G K Q A Q L G K<br>361 CTCCGAGCGCTGGCCCAGCACAAGGACGTGTGTCAGGGCAAACAGGCCCAGCTTGGGAAA<br>141 G K E I S A P E C K F S C W Y C N E M I<br>421 GGGAAGGAAATTTCAGCCTCCTGAATGCAAATTCAGCTGTTGGTATTGCAACGAAATGATT<br>161 P G D K Y S H H V D K C R T V S K S V K<br>481 CCAGGAGATAAGTATTCCCACCACGTGGATAAATGTCGCACAGTCTCAGAGTCTGTGAAA<br>181 Y F P V G K P R I P P P P S L P S Q A A E<br>541 TATTTVCCAGTTGGAAAGCCAAGAATTCCTCCTCCATCCCTTCCAAGCCAGGCTGCTGAA<br>201 D Q S S T A E K D V R P K T R S I N R F<br>601 GATCAATCTTCCACGGCAGAGAAAGATGTCCGTCCAAAGACAAGAAGTATAAACAGATTT<br>221 P L H S E S S S K K A P R S K N K T L D<br>661 CCTCTTCATTCTGAAAGTTCATCAAAGAAAGCACCAAGAAGCAAAAACAAAACCTTGGAT<br>241 P L L M S E P K P R T S S P R G D K A A<br>721 CCACTTTTGATGTCAGAGCCCAAGCCCAGGACCAGCTCCCCTAGAGGAGATAAAGCAGCC<br>261 Y D I L R R C S Q C G I L L P L P I L N<br>781 TATGACATTCTGAGGAGATGTTCTCAGTGTGGCATCCTGCTTCCCCTGCCGATCCTAAAT<br>281 Q H Q E K C R W L A S S K R K T S E K F<br>841 CAACATCAGGAGAAATGCCGGTGGTTAGCTTCATCAAAAAGGAAAACAAGTGAGAAATTT<br>301 Q L D E K E R Y Y K F K R F H F -<br>901 CAGCTAGATTTGGAAAAGGAAAGGTACTACAAATTCAAAAGATTTCACTTTTAA | |
| Foe1268 | Myo-inositol 1-phosphate synthase A1 | 1 ATGGGGATGGGGATGCTGAGGCCCAGTGGAATCCCCCGGCCCCAAGATGCCAGCAGGGAC<br>61 GGCTGTCCTTGTCCCATCCTCCAGCTCTCCCCGATGGAGGCCTCAGCCGAGTTCGTGGTC<br>121 GAGAGCCCCGACGTGGTCTACGGCCCCAGACGCCATCGAGGCTCAGTGTACCCCACCTCC<br>181 ACGCGCTTCACCTTTCGGACCGCCCGGCAGGTGCCCGGCTCGGGTCATGCTCGTCGGC<br>241 TGGGGCGGGAACAACGGCTCCACGCTCACCGCCGCCGTGCTGGCCAACCGGCTGCGCCTG<br>301 TCCTGGCCCACGCGCACCGGCCGCAAGGAGGCCAACTACTACGGCTCGCTGACGCAGGCG<br>361 GGCACCGTTAGCCTGGGCTTGGACGCCGAGGGCCAGGAGGTGTTCGTGCCCTTCAGCGCA<br>421 CTGCTGCCCATGGTGGCACCCGACGACCTCGTGTTCGACGGCTGGGACATATCGTCGCTG<br>481 AACCTGGCTGAGGCGATGAGGCGTGCACAGGTGCTGGACTGGGGGCTGCAGGAGCAACTG<br>541 TGGCCACACTTGGAGGCTCTGCGCCCTCGGCCCTTCCGTCTACATCCCCGAATTCATCGCA<br>601 GCCAACCAGAGTGTGCGAGCTGACAATCTCATACTGTGCACGCGCGCACAGCAGCTGGAG<br>661 CAGATCCGTAGGGACATCCGTGACTTCCGATCCAGTGCTGGGCTAGACAAAGTCATCGTG<br>721 CTGTGGACCGCAAACACGGAGCGCTTCTGCGAAGTCATCCCCGGCCTCAATGATACTGCT<br>781 GAGAACCTGCTGCGTACCATCCAGCTGGGCCTGGAGGTGTCGCCCTCCACTCTTTTTGCT<br>841 GTGGCCAGCATCTTGGAGGGCTGTGCCTTCCTCAACGGGTCCCCGCAGAACACGCTGGTG<br>901 CCTGGGGCGCTTGAGCTCGCCCGTCAGCGACGTGTCTTCGTGGGTGGAGATGACTTCAAG<br>961 TCAGGCCAAACCAAGGTCAAGTCCGTGCTGGTGGACTTCCTTATCGGCTCTGGCCTCAAG<br>1021 ACCATGTCCATCGTGAGCTACAACCACCTGGGCAACAATGACGGGCAGAACCTGTCGGCA<br>1081 CCGCCGCAGTTCCGTTCCAAGGAGGTGTCCAAGAGCGTGGTAGACGACATGGTGCAG<br>1141 AGCAACCCTGTGCTCTATGCACCCGGCGAGGAGCCCGACCACTGTGTGGTCATCAAGTAC<br>1201 GTGCCATACGTGGGCGACAGCAAGCGTGCGTTGGATGAGTACACCTCGGAGCTGATGCTG<br>1261 GGCGGCACCAACACGCTGGTGCTGCACAACACCTGTGAGGACTCCCTCCTGGCCGCACCC<br>1321 ATCATGCTGGACCTGGTGCTGCTGACCGAGCTGTGCCAGCGCGTGAGCTTCTGCACCGAT<br>1381 GCCGACCCAGAGCCGCAGGGCTTCCACTCCGTGTGTCCCTGCTCAGCTTCCTATTCAAG<br>1441 GCGCCACTCGTGCCGCCGGGCAGCCCTGTGGTCAATGCCCTCTTCCGCCAGCGCAGCTGC<br>1501 ATCGAGAATATCCTCAGGGCCTGTGTGGGGCTCCCCCACAGAACCACATGCTTCTGGAG<br>1561 CACAAGATGGAGCGCCCTGGCCTCAAGCGAGTGGGGCCTATGGTTGCTGCCTGCCCTGTG<br>1621 CCCTGCAAGAAAGGACCAGCGCCAACTGCCCCCAATGGCTGTACGGGTGATGCCAATGGG<br>1681 CACTCGCAGGCTGAGGCACCCCAGATGCCCACCACTTAAGGCCATGGCCATCCTTCTCCC<br>1741 CCCAACTGTAAGCCTCTGTTGCCCCTCAGGACCCAACCCTTCCAAGACCCTAAAGACAAT<br>1801 AAAACCAGTGCTACAATCA<br><br>1 MGMGMLRPSGIPRPQDASRDGCPCPILQLSPMEASAEFVVESPDVVYGPRRHRGSVYPTS<br>61 TRFTFRTARQVPRLGVMLVGWGGNNGSTLTAAVLANRLRLSWPTRTGRKEAAYYGSLTQA<br>121 GTVSLGLDAEGQEVFVPFSALLPMVAPDDLVFDGWDISSLNLAEAMRRAQVLDWGLQEQL<br>181 WPHLEALRPRPSVYIPEFIAANQSVRADNLILCTRAQQLEQIRRDIRDFRSSAGLDKVIV<br>241 LWTANTERFCEVIPGLNDTAENLLRTIQLGLEVSPSTLFAVASILEGCAFLNGSPQNTLV<br>301 PGALELARQRRVFVGGDDFKSGQTKVKSVLVDFLIGSGLKTMSIVSYNHLGNNDGQNLSA<br>361 PPQFRSKEVSKSSVVDDMVQSNPVLYAPGEEPDHCVVIKYVPYVGDSKRALDEYTSELML<br>421 GGTNTLVLHNTCEDSLLAAPIMLDLVLLTELCQRVSFCTDADPEPQGFHSVLSLLSFLFK<br>481 APLVPPGSPVVNALFRQRSCIENILRACVGLPPQNAALLEHKMERPGLKRVGPMVAACPV<br>541 PCKKGPAPTAPNGCTGDANGHSQAEAPQMPTT- | SEQ ID NO: 89<br><br><br><br><br><br><br><br><br><br><br><br><br><br><br><br><br><br><br><br><br><br><br><br><br><br><br><br><br><br>SEQ ID NO: 90 |
| WBC035E08 | Homo sapiens ubiquitin-conjugating enzyme E2D 1 (UBC4/5 homolog | 1 GGGGACACTCGCGCACACTCGCGCTCGGGCGCACACGGAGCAGGGACCGGCGCCCGGAGC<br>61 GAGCCAGGGAGCGGCTAACCGGGGACCCACCGCGCGGAGCCAGCCTAGCTGCCAGCGAGC<br>121 CCAACCCGCGACGACCCACGCCCCTGAGCCCCGCAGCCGACCCCTGCCGGCCGGTGTCCC<br>181 CACCGCCATCCCTGACCCATGGCGCTGAAGAGGATTCAGAAAGAATTGAGTGATCTACAG<br>241 CGCGATCCACCTGCTCACTGTTCAGACCTGTGGAGACATGTCTTGTTCCACTGGCAA<br>301 GCCACTATTATGGGGCCTCCTGATAGCGCATATCAAGGTGGAGTCTTCTTTCTCACTGTA<br>361 CATTTTCCGACAGATTATCCTTTTAAACCACCAAAGATTGCTTTCACAACAAAAATTTAC<br>421 CATCCAAACATAACAGTAATGGAAGTATTTGTCTCGATATTCTGAGGAACACAATGGTCA<br>481 CCAGCTCTGACTGTATCAAAAGTTTTA&TGTCCATATGTTCTCTACTTTGTGATCCTAAT<br>541 CCAGATGACCCCTTAGTACCAGATATTGCACAAATCTATAAATCAGACAAAGAAAAATAC | SEQ ID NO: 91 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 601 AACAGACATGCAAGAGAATGGACTCAGAAATATGCAATGTAAAAATCAAAAACATTTTCA<br>661 TATATACCAGAGTACTGTAAAATCTAGGTTTTTTTCAACATTAGCAGTAGTAAATTGAGCACT<br>721 GTTTACTGTTTCATTGTACCATGAAACATTTGATTTTTACCCATTTTAAATGTGTTTCT<br>781 GAAGCAAGACAAAACAAACTTCCAAAAATACCCTTAAGACTGTGATGAGAGCATTTATCA<br>841 TTTTGTATGCATTGAGAAAGACATTTATTATGGTTTTTAAGATACTTGGACATCTGCATC<br>901 TTCAGCTTACAAGATCTACAATGCAGCTGAAAAGCAACCAAATTATTTTTTGCTGAAACT<br>961 AGATGTTTTTACATGAGAAATACTGTATGTGTTGTCTAAGATGTCAGTTTTATAAATCTG<br>1021 TATTCAGATTTCATTCTTTGTTAGCTCACTTTATAATTTGTATTTTTTTACTGTATAGAC<br>1081 TAAATATATTCTATTTACATGTATGTCAACTCATTACTTTTTTCCTGTGAACAGTATTGA<br>1141 AAAACCCCAACGGCTGATAATTAAGTGAATTAACTGTGTCTCCCTTGTCTTAGGATATTC<br>1201 TGTAGATTGATTGCAGATTTCTTAAATCTGAAATGATCTTTACACTGTAATTCTCAGCAT<br>1261 ACTGATTATGGAGAAACACTTGTTTTGATTTGTTATACTTGACTTAACTTTATTGCAAT<br>1321 GTGAATTAATTGCACTGCTAAGTAGGAAGATGTGTAACTTTTATTGTTGCTATTCACAT<br>1381 TTGAATTTTTTCCTGTATAGGCAATATTATATTGACACCTTTTACAGATCTTACTGTAGC<br>1441 TTTTTCCATATAAATAAAATGCTTTTTCTACTATTTGTCTTGATTACTTAAAAAAATAAA<br>1501 AATATAAGTAAGGATTAAAAAAAAAAAAAAAAAAAAAAAAAAAA<br><br>   1  M  A  L  K  R  I  Q  K  E  L  S  D  L  Q  R  D  P  P  A  H<br>   1 ATGGCGCTGAAGAGGATTCAGAAAGAATTGAGTGATCTACAGCGCGATCCACCTGCTCAC<br>  21  C  S  A  G  P  V  G  D  D  L  F  H  W  Q  A  T  I  M  G  P<br>  61 TGTTCAGCTGGACCTGTGGGAGATGACTTGTTCCACTGGCAAGCACTATTATGGGGCCT<br>  41  P  D  S  A  Y  Q  G  G  V  F  F  L  T  V  H  F  P  T  D  Y<br> 121 CCTGATAGCGCATATCAAGGTGGAGTCTTCTTTCTCACTGTACATTTTCCGACAGATTAT<br>  61  P  F  K  P  P  K  I  A  F  T  T  K  I  Y  H  P  N  I  N  S<br> 181 CCTTTTAAACCACCAAAGATTGCTTTCACAACAAAAATTTACCATCCAAACATAAACAGT<br>  81  N  G  S  I  C  L  D  I  L  R  S  Q  W  S  P  A  L  T  V  S<br> 241 AATGGAAGTATTTGTCTCGATATTCTGAGGTCACAATGGTCACCAGCTCTGACTGTATCA<br> 101  K  V  L  L  S  I  C  S  L  L  C  D  P  N  P  D  D  P  L  V<br> 301 AAAGTTTTATTGTCCATATGTTCTCTACTTTTGTGATCCTAATCCAGATGACCCCTTAGTA<br> 121  P  D  I  A  Q  I  Y  K  S  D  K  E  K  Y  N  R  H  A  R  E<br> 361 CCAGATATTGCACAAATCTATAAATCAGACAAAGAAAAATACAACAGACATGCAAGAGAA<br> 141  W  T  Q  K  Y  A  M  -<br> 421 TGGACTCAGAAATATGCAATGTAA | SEQ ID NO: 92 |
| BM734719.V1.3_AT | No Homology |    1 AGTCCTCTCGATGAAGCTTCTTCCCACCTAGAAAGAAGTCCTCTCTGAGACTCAAGGGCT<br>  61 AAGGCAAGGTCTTCCAGAAAACAAGGCTTTGACTCCAAGAACAGAGGTGATGGGGAGACT<br> 121 TCTTGGCTCGGCGGGGAAAGGAGGACGCCAATGGGTCAAACTAACTCTGAATCCCTCCCT<br> 181 CCATCTCTCTTTTTCCACTGTCGTCAGAGCCAACAAGAAATGACAGCCTCCAAGCCTTCC<br> 241 TAAAAGCACACTTGCCCCCGCCTGCCACCTCTCCTCAGGCTGCTGCCCTCCCAGGCGCTC<br> 301 CACAGCGAAGGGGTGTGGTGTTTCCTGCAGGCCAGGCCAGCTGCCTCAGCCCCGCCAAAA<br> 361 CTGTGTTCCCAGCCAGCGCTCTGGAGCAGGGATGACGTGTGGCCAGCCCTTCTCAGGTCT<br> 421 CAGCTCTGCTGGGATGGGAGGAGAGGCCAGGGAGAAAGGTTAGGGGCCCAGGGGTGGGTG<br> 481 ACAACGCTGGCTGCTGAAAGCCCATGAGCTGCTTCTTTGTTCTCTGTCACGGGACAAAAA<br> 541 TCTCTCATCCTATTCTGCTTTCAGTTCATTAAGAGAGCACATTTTACTCATACACAAATA<br> 601 AAAGTTTTCCCTTGTGGAAACAACAGCTTTAAAGAAAGG | SEQ ID NO: 93 |
| BM781127.V1.3_AT | Homo sapiens acid phosphatase 5, tartrate resistant (ACP5), mRNA. |    1 AGGGAATAAAGGCTCAGGGACCGGCAGTTCTACTCTAGAGCCCACCAGCCTCTCAGAGCC<br>  61 TCCGGTGACTGGCCTGTGTCTCCCCCTGGATGGACATGTGGACGGCGCTGCTCATCCTGC<br> 121 AAGCCTTGTTGCTACCCTCCCTGGCTGATGGTGCCACCCCTGCCCTGCGCTTTGTAGCCG<br> 181 TGGGTGACTGGGGAGGGGTCCCCAATGCCCCATTCCACACGGCCCGGGAAATGGCCAATG<br> 241 CCAAGGAGATCGCTCGGACTGTGCAGATCCTGGGTGCAGACTTCATCCTGTCTCTAGGGG<br> 301 ACAATTTTTACTTCACTGGTGTGCAAGACATCAATGACAAGAGGTTCCAGGAGACCTTTG<br> 361 AGGACGTATTCTCTGACCGCTCCCTTCGCAAAGTGCCCTGGTACGTGCTAGCCGGAAACC<br> 421 ATGACCACCTTGGCAATGTCTCTGCCCAGATTGCATACTCTAAGATCTCCAAGCGCTGGA<br> 481 ACTTCCCCAGCCCTTTCTACCGCCTGCACTTCAAGATCCCACAGACCAATGTGTCTGTGG<br> 541 CCATTTTTATGCTGGACACAGTGACACTATGTGGCAACTCAGATGACTTCCTCAGCCAGC<br> 601 AGCCTGAGAGGCCCCGAGACGTGAAGCTGGCCCGCACACAGCTGTCCTGGCTCAAGAAAC<br> 661 AGCTGGCCGCGGCCAAGGAGGACTACGTGCTGGTGGCTGGCCACTACCCAATATGGTCCA<br> 721 TCGCGGAGCACGGGCCCACCCACTGCCTCGTCAAGCAGCTGCTGCCACTGCTGGCCATGC<br> 781 ACAAGGTCACCGCCTACCTGTGTGGCCACGACCACAACCTGCAGTACCTTCAAGACGAGA<br> 841 ACGGCATAGGCTTTGTGCTAAGCGGCGCTGGGAACTTCATGGACCCCTCGACGAAGCACG<br> 901 CACGCAAGGTCCCCAATGGCTACCTGCGCTTCCACCACGGGACCAACACCTCCATGGGTG<br> 961 GCTTTGCCTACGTGGAGATCAGCCCCAAAGAGATGACCGTCACTTACATCGAAGCTTCGG<br>1021 GCAAGTCCCTGTTCAAGACCAGGCTGCCCAGGAGAGCAAGGCCCTGAACTCCCATGACTG<br>1081 CCCAGCTCTGAGGCCCGATCTCCACTGTTGGGTGGGTGGCCTGCCGGGACCCTGCTCACA<br>1141 GGCAGGCTTTTCCTCCAACCTGTGGCGCTGCAGCAGGGCAGGAAGGGGAAACACAGCTGA<br>1201 TGAACTGTGGTGCCACGTGGCCCTTGTGGCAAGGATGCCCACGGATGTGAAACACACATG<br>1261 GACATGTGTCCCAGCCACAGTGTTATGCTCTGTGGCTGGCTCACCTTTGCTGAGTTCCGG<br>1321 GGTGCAATGGGGGAGGGAGGGAAAGCTTCCTCCTAATCAAGCATCTTTCTGTTAC<br>1381 TGATGTTCAATAAAAGAATAGTTGCCAAGGCTG | SEQ ID NO: 94 |

TABLE 1-continued

| Gene | GenBank Homology | DNA SEQUENCE/DEDUCED AMINO ACID SEQUENCE | SEQUENCE IDENTIFIER: |
|---|---|---|---|
| | | ``` 
  1 M  D  M  W  T  A  L  L  I  L  Q  A  L  L  L  P  S  L  A  D
  1 ATGGACATGTGGACGGCGCTGCTCATCCTGCAAGCCTTGTTGCTACCCTCCCTGGCTGAT
 21 G  A  T  P  A  L  R  F  V  A  V  G  D  W  G  G  V  P  N  A
 61 GGTGCCACCCCTGCCCTGCGCTTTGTAGCCGTGGGTGACTGGGGAGGGGTCCCCAATGCC
 41 P  F  H  T  A  R  E  M  A  N  A  K  E  I  A  R  T  V  Q  I
121 CCATTCCACACGGCCCGGGAAATGGCCAATGCCAAGGAGATCGCTCGGACTGTGCAGATC
 61 L  G  A  D  F  I  L  S  L  G  D  N  F  Y  F  T  G  V  Q  D
181 CTGGGTGCAGACTTCATCCTGTCTCTAGGGGACAATTTTTACTTCACTGGTGTGCAAGAC
 81 I  N  D  K  R  F  Q  E  T  F  E  D  V  F  S  D  R  S  L  R
241 ATCAATGACAAGAGGTTCCAGGAGACCTTTGAGGACGTATTCTCTGACCGCTCCCTTCGC
101 K  V  P  W  Y  V  L  A  G  N  H  D  H  L  G  N  V  S  A  Q
301 AAAGTGCCCTGGTACGTGCTAGCCGGAAACCATGACCACCTTGGCAATGTCTCTGCCCAG
121 I  A  Y  S  K  I  S  K  R  W  N  F  P  S  P  F  Y  R  L  H
361 ATTGCATACTCTAAGATCTCCAAGCGCTGGAACTTCCCCAGCCCTTTCTACCGCCTGCAC
141 F  K  I  P  Q  T  N  V  S  V  A  I  F  M  L  D  T  V  T  L
421 TTCAAGATCCCACAGACCAATGTGTCTGTGGCCATTTTTATGCTGGACACAGTGACACTA
161 C  G  N  S  D  D  F  L  S  Q  Q  P  E  R  P  R  D  V  K  L
481 TGTGGCAACTCAGATGACTTCCTCAGCCAGCAGCCTGAGAGGCCCCGAGACGTGAAGCTG
181 A  R  T  Q  L  S  W  L  K  K  Q  L  A  A  A  K  E  D  Y  V
841 GCCCGCACACAGCTGTCCTGGCTCAAGAAACAGCTGGCCGCGGCCAAGGAGGACTACGTG
201 L  V  A  G  H  Y  P  I  W  S  I  A  E  H  G  P  T  H  C  L
601 CTGGTGGCTGGCCACTACCCAATATGGTCCATCGCGCAGCACGGGCCCACCCACTGCCTC
221 V  K  Q  L  L  P  L  L  A  M  H  K  V  T  A  Y  L  C  G  H
661 GTCAAGCAGCTGCTGCCACTGCTGGCCATGCACAAGGTCACCGCCTACCTGTGTGGCCAC
241 D  H  N  L  Q  Y  L  Q  D  E  N  G  I  G  F  V  L  S  G  A
721 GACCACAACCTGCAGTACCTTCAAGACGAGAACGGCATAGGCTTTGTGCTAAGCGGCGCT
261 G  N  F  M  D  P  S  T  K  H  A  R  K  V  P  N  G  Y  L  R
781 GGGAACTTCATGGACCCCTCGACGAAGCACGCACGCAAGGTCCCCAATGGCTACCTGCGC
281 F  H  H  G  T  N  T  S  M  G  G  F  A  Y  V  E  I  S  P  K
841 TTCCACCACGGGACCAACACCTCCATGGGTGGCTTTGCCTACGTGGAGATCAGCCCCAAA
301 E  M  T  V  T  Y  I  E  A  S  G  K  S  L  F  K  T  R  L  P
901 GAGATGACCGTCACTTACATCGAAGCTTCGGGCAAGTCCCTGTTCAAGACCAGGCTGCCC
321 R  R  A  R  P  -
961 AGGAGAGCAAGGCCCTGA
``` | SEQ ID NO: 95 |
| WBC048H02.bFSP_20021501.esd | Homo sapiens guanine nucleotide binding protein (G protein), beta polypeptide 2-like 1 (GNB2L1), mRNA. | ```
   1 CTGCAAGGCGGCGGCAGGAGAGGTTGTGGTGCTAGTTTCTCTAAGCCATCCAGTGCCATC
  61 CTCGTCGCTGCAGCGACACCGCTCTCGCCGCCGCCATGACTGAGCAGATGACCCTTCGTG
 121 GCACCCTCAAGGGCCACAACGGCTGGGTAACCCAGATCGCTACCACCCCGCAGTTCCCAG
 181 ACATGATACTGTCGGCCTCGCGAGACAAGACCATCATCATGTGGAAGCTGACCAGGGATG
 241 AGACCAACTACGGCATCCCACAGCGTGCTCTTCGAGGTCACTCCCACTTTGTTAGTGACG
 301 TGGTGATCTCTTCAGATGGCCAGTTTGCCCTCTCAGGCTCCTGGGATGGAACGCTTCGCC
 361 TCTGGGATCTCACAACGGGCACCACCACACGCCGATTTGTGGGCCATACCAAGGATGTGC
 421 TGAGTGTGGCATTCTCCTCTGACAACCGGCAGATTGTCTCTGGCTCCCGAGATAAAACCA
 481 TCAAGCTATGGAATACTCTGGGTGTATGCAAATACACTGTCCAGGATGAGAGCCACTCGG
 541 AGTGGGTGTCTTGTGTCCGCTTCTCACCCAACAGTAGCAATCCCATCATTGTCTCCTGTG
 601 GCTGGGACAAGCTAGTCAAGGTGTGGAATTTGGCAAACTGCAAGCTGAAGACCAATCACA
 661 TCGGCCACACAGGCTACCTGAACACTGTCACTGTCTCTCCGGATGGATCCCTCTGTGCTT
 721 CTGGAGGCAAGGATGGCCAGGCCATGCTTTGGGATTTAAATGAAGGCAAGCACCTTTACA
 781 CACTAGATGGTGGGGACATCATCAACGCCTTGTGCTTCAGTCCCAATGCTACTGGCTCT
 841 GTGCTGCCACAGGCCCCAGCATCAAGATCTGGGACTTGGAGGGCAAGATCATTGTAGATG
 901 AACTGAAGCAAGAAGTTATCAGTACCAGCAGCAAGGCAGAGCCACCCCAGTGCACTTCTC
 961 TTGCCTGGTCTGCTGATGGCCAGACTCTGTTTGCTGGCTACACGGACAACCTGGTGAGAG
1021 TGTGGCAGGTGACCATCGGCACCCGCTAGAAATACATGGCAAGCTTTAGAAATAAAAAAA
1081 AAATGGCTTTTC
``` | SEQ ID NO: 96 |
| | | ```
  1 M  T  E  Q  M  T  L  R  G  T  L  K  G  H  N  G  W  V  T  Q
  1 ATGACTGAGCAGATGACCCTTCGTGGCACCCTCAAGGGCCACAACGGCTGGGTAACCCAG
 21 I  A  T  T  P  Q  F  P  D  M  I  L  S  A  S  R  D  K  T  I
 61 ATCGCTACCACCCCGCAGTTCCCAGACATGATACTGTCGGCCTCGCGAGACAAGACCATC
 41 I  M  W  K  L  T  R  D  E  T  N  Y  G  I  P  Q  R  A  L  R
121 ATCATGTGGAAGCTGACCAGGGATGAGACCAACTACGGCATCCCACAGCGTGCTCTTCGA
 61 G  H  S  H  F  V  S  D  V  V  I  S  S  D  G  Q  F  A  L  S
181 GGTCACTCCCACTTTGTTAGTGACGTGGTGATCTCTTCAGATGGCCAGTTTGCCCTCTCA
 81 G  S  W  D  G  T  L  R  L  W  D  L  T  T  G  T  T  T  R  R
241 GGCTCCTGGGATGGAACGCTTCGCCTCTGGGATCTCACAACGGGCACCACCACACGCCGA
101 F  V  G  H  T  K  D  V  L  S  V  A  F  S  S  D  N  R  Q  I
301 TTTGTGGGCCATACCAAGGATGTGCTGAGTGTGGCATTCTCCTCTGACAACCGGCAGATT
121 V  S  G  S  R  D  K  T  I  K  L  W  N  T  L  G  V  C  K  Y
361 GTCTCTGGCTCCCGAGATAAAACCATCAAGCTATGGAATACTCTGGGTGTATGCAAATAC
141 T  V  Q  D  E  S  H  S  E  W  V  S  C  V  R  F  S  P  N  S
421 ACTGTCCAGGATGAGAGCCACTCGGAGTGGGTGTCTTGTGTCCGCTTCTCACCCAACAGT
161 S  N  P  I  I  V  S  C  G  W  D  K  L  V  K  V  W  N  L  A
481 AGCAATCCCATCATTGTCTCCTGTGGCTGGGACAAGCTAGTCAAGGTGTGGAATTTGGCA
``` | SEQ ID NO: 97 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 181 N C K L K T N H I G H T G Y L N T V T V<br>541 AACTGCAAGCTGAAGACCAATCACATCGGCCACACAGGCTACCTGAACACTGTCACTGTC<br>201 S P D G S L C A S G G K D G Q A M L W D<br>601 TCTCCGGATGGATCCCTCTGTGCTTCTGGAGGCAAGGATGGCCAGGCCATGCTTTGGGAT<br>221 L N E G K H L Y T L D G G D I I N A L C<br>661 TTAAATGAAGGCAAGCACCTTTACACACTAGATGGTGGGGACATCATCAACGCCTTGTGC<br>241 F S P N R Y W L C A A T G P S I K I W D<br>721 TTCAGTCCCAATCGCTACTGGCTCTGTGCTGCCACAGGCCCCAGCATCAAGATCTGGGAC<br>261 L E G K I I V D E L K Q E V I S T S S K<br>781 TTGGAGGGCAAGATCATTGTAGATGAACTGAAGCAAGAAGTTATCAGTACCAGCAGCAAG<br>281 A E P P Q C T S L A W S A D G Q T L F A<br>841 GCAGAGCCACCCCAGTGCACTTCTCTTGCCTGGTCTGCTGATGGCCAGACTCTGTTTGCT<br>301 G Y T D N L V R V W Q V T I G T R -<br>901 GGCTACACGGACAACCTGGTGAGAGTGTGGCAGGTGACCATCGGCACCCGCTAG | |
| B1961469 | No homology | 1 GATTCCGGATGAGCCACCCAGCCCTTCTGGCCCTGCTGTGGCTCGCCCAAAAGTCGCCCA<br>61 AGAAGAAAGGATCACTCCAGCATCCAGTGACAACCTGAACCCCCAAATAAAAGTCAAAGA<br>121 AGACACTCAAGAAATGCCCTGTGCTCCCTCAGGCCCAGTGCAAGTGATACGAGATGATTC<br>181 TCCTGAACCAAATGATGCAGAAGAGCCCCAGGAGGCATCCAGCACACCTCCCACAAAGAA<br>241 AGGAAAGAAAAGAAAAAGAAATGTGTGGTCAATTCCAAAGAAGAGATATCATAAAAAAAG<br>301 CCTCCCAAAAGGGACAGTCTCACCTGGGGATGAAATCCAAGAGAAGCTCCAAGTGGTGGA<br>361 TCAGGCAACTCAAAAGAAGGACGACTCAACCAGGAACTCAAAGGTCACGACAAGGGTCCA<br>421 AAAAGCCAGGACTGGATGTGCCCAAACATCTGGACCAGAGGAGGTCAGTGATGACGCTTC<br>481 AGAAGTG | SEQ ID NO: 98 |
| | | NON CONGIGUOUS<br>1 GACCTTGATGTTTGGATGATTACAAACCAAAAGTGTCAGAAATAGAGTACTCTGATTTGA<br>61 AAAGCAAATATGGTACTGAAATAGACAAGAACAGTATGTGAAAGGGCTAGAAGATCATCC<br>121 TTGGTTGAACATTAAGTATACCTCAATTCAACATGCTCACTATCAGTAGCAGCAGAATGG<br>181 AACAATTGPTTGAACTGAGCTTTGTCTCTGCAGCACCTCCCTCCAGGTCAAAATGGCAGT<br>241 CATCCATTGGCTGCACCAGCTGTTCCTCCTCACCCTTCTTTATGTGCTTAGATACGTGCT<br>301 CCAGACACAAGTCCCATTCATGAGCTTCCTGTTAGATGTGAACCTCCAGCAGAGGCAACG<br>361 CTTCCTCTCCCATCCPPGCCCTGAAGGCTGGCCTGCCCCPTGGCPGGATTCATTCAAAGTT<br>421 GATAAAGCAATGGTCCTCAATTCTGTTTATTGGTAAACCATCTTTTCCATGCTGATTTGA<br>481 AACACGTTAGAT | SEQ ID NO: 99 |
| WBC021A01 | No homology | 1 GACAATGTTTGTGCTTGATTGCTCCTTTAAATCCAGCGTGCCATTGATTCTGCATGCCCA<br>61 CCTCATCCTGGCCTTCCTGATGGAAATAGGTTAAGAGAACCAGTCCTGTCTTCACCCTCG<br>121 AGAGAAACTTAGGTGAGGCTGGTCAGTTCAGTGCTTTCTTAGPGCATGTCTGCTGTATGT<br>181 TTCTGGCACCCATGCCCAACCAGGTTTTTAGAGATTTCAGACATCTTAAAGATGCAAATG<br>241 CTTCCCAGCATTTTTGTTTGTGTAGCCCTGCTTGCTTTAGCGTATGCTTGAATAAAAAGC<br>301 ATTGCAGCTAAGGCAGCTGTAAGAAAAAGGTACTTCTTCAGAAGTAAGCAACTCATCTTT<br>361 AAAGCACCCTCAAATGAATTTTGTTTTTCCTTCTTATGTTGAGGTAGAGTCAAAATAGAT<br>421 GGTGTTTTATTTTTTGCTGTTTGGGTTACCAGCTCTGTGGACTCTCCGACCTTCCCTTCC<br>481 CAGTTCACACATTTCCATTAGGATGCAGCCTGCTGGATGTATGCATTTCACCCCGAGTCC<br>541 ATCGGTCAGCCAGTACACATTGAGTGCCTGCTTTCAGTCAAGGCAGCTGATGTGAGGGGC<br>601 TCATCGTGTTGGCAGCAATATCCCAGCAGCAGTCTTTTTCTATTCTCCCTGTCTTGGATG<br>661 CTCCGGGGGTATCAGGCATCTGGCTGCTTGAAGCCTGGGCCCTCAGCCCTTTGCATTC<br>721 TCCTTANAGAGGAGGCCTGCTGCCCTTCTCTTTCTGGGTCGGAACTTCTCATTCTTGGCA<br>781 TGTTTCTGGACTACATGCATATGGGCAGCTATTCATTAATCTGCAGAACCCAATGTCAGC<br>841 CATCCATGATGTCTGGAGCGGGTAGCATTCGTTTCAAAGAAGCCTCGTTTCTCGGGGAGG<br>901 GCGATTCTGTCTATACTTTGAAGGGGGTGTATTTACCCCCATACCCC | SEQ ID NO: 100 |
| | | NON CONTIGUOUS<br>1 CTCAAACCCAAGCCAAGGGTAATTTTTACTTGAAACTAGGAGAGTGGGGAAGACACTAGA<br>61 GAGAAGGGGTGAGTCGTGCAGGTGGGCCACCTGCCCCTGGTGTCTGTCCACGTCACTGAG<br>121 TGCTGTGAGCCAGTGCCTTTCCTGCACCTGAACATGGAGCCCGCTCTTCCCGCCTGGGTG<br>181 AAGAGACCTCGCTGCCCAGGGGTAGACCTTGAAGAAGGTGTCTTGGAGAGCCCAGAGGAC<br>241 ACTCACGTATTCAGGTGCCCATTTTAAGCATCTTTAAAATATTTTATAGATAAAAGCATG<br>301 CCCTTTCCTGTCGGTGCCACCAGTGGTGCAGTTCCATCCATTCTGAATGGAAAAGTGGAG<br>361 CCTGCCAGTGCTTTCCTGGGTCACTCCTTCATCTCCCTTGATGTGGTGTCCCTCCCCCT<br>421 CCCGTCCATTTCACTGTCGTGGCTGGATAGCAGAGGGCACCATGTAGTCCTGACGCAGTC<br>481 CTGTGTGATTCCGTGATCAGTTTTTTCTGTAACTGTCCTTCCAAACCAGTTGATGTTTGG<br>541 AAATTAGGGAAAAAATTAAATTCTCACCAATGGTTGCTGTTACAGTTAAATCAATAAAGA<br>601 TCTTGAGTATCAAAAAAAAAAAAAAAAAAAAAA | SEQ ID NO: 101 |
| B1961499 | Homo sapiens SUI1 isolog | 1 CGGCACGAGCGCCGCCGAGGATTCAGCAGCCTCCCCCTTGAGCCCCCTCGCTTCCCGACG<br>61 TTCCGTTCCCCCTGCCCGCCTTCTCCCGCCACCGCCGCCGCCGCCTTCCGCAGGCCGTT<br>121 TCCACCGAGGAAAAGGAATCGTATCGTATGTCCGCTATCCAGAACTCCACTCTTTGAC<br>181 CCCTTTGCTGATGCAAGTAAGGGTGATGACCTCGTTCCTGCTGGCACTGAGGATTATATC<br>241 CATATAAGAATTCAACAGAGAAACGGCAGGAAGACCCTTACTACTGTCAAGGGATCGCT<br>301 GATGATTACGATAAAAAGAAACTAGTGAAGGCGTTTAAGAAAAAGTTTGCCTGCAATGGT<br>361 ACTGTAATTGAGCATCCGGAATATGGAGAAGTAATTCAGCTACAGGGTGACCAACGCAAG<br>421 AACATATGCCAGTTCCTCGTAGAGATTGGACTGGCTAAGGACGATCAGCTGAAGGTTCAT | SEQ ID NO: 102 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 481 GGGTTTTAAGTGCTTGTGGCTCACTGAAGCTTAAGTGAGGATTTCCTTGCAATGAGTAGA<br>541 ATTTCCTTCTCTCCCTTGTCACAAGGTTTAAAAACCTCACAGCTTGTATAATGTAACCAT<br>601 TTGGGGTCCGCTTTTAACTTGGACTAGTGTAACTCCTTCATGCAATAAACTGAAAAGAGC<br>661 CATGCTGTCTAGTCTTGAAGTCCCTCATTTAAACAGAGGTCAAGCAATAGGCGCCTGGCA<br>721 GTGTCAAGCCTGAAACCAAGCAATACCGTCATGTTTCAGCCAAGCCCAGAGCCCTAAGAT<br>781 TACAAACAACTATGGCCGGAACCTCCTCAGCTCTCCCTCTGCAGAGTTCCCTACCCTAAG<br>841 AGAATGTTACCACCTGAACAGTCCTCGGTGAATCTGAGAGGAGAGGATGGGGTAAGGCAG<br>901 AAGCACCAGCTGTACTACTAGAAGGGAGCTTTTGGTGGTAGATCCCCTGGTGTCTCCAAC<br>961 CTGACTAGGTGGACAGAGCTCAAAGAGGCCCTCTTACCGCTAGCGAGGTGATAGGACATC<br>1021 TGGCTTGCCACAAAGGTCTGTTCGACCAGACATATCCTAGCTAAGGGATGTCCAAACATC<br>1081 AGAATGTGAGGCCAACCTTCTATCAGAGTTAAACTTTTGACAAGGGAACAAATCTCAAAC<br>1141 TGATCCATCAGTCATGTAGCTAGCTGTAGAGCTTGCAACTTAATAGCAGCAGCTGCCCAA<br>1201 TGCCATGTGAAGTAACAAACTGGTTTTTGGTTTTTTTTTCCCCTTCAGTTTTAATGTTAT<br>1261 GTGTAATGTATTTAAACCCTTATTTAAATAAAACTTGTTTTCAGAAAAAAAAAAAAAAAA<br>1321 AAAA | |
| | |   1 M  S  A  I  Q  N  L  H  S  F  D  P  F  A  D  A  S  K  G  D<br>  1 ATGTCCGCTATCCAGAACCTCCACTCTTTCGACCCCTTTGCTGATGCAAGTAAGGGTGAT<br> 21 D  L  L  P  A  G  T  E  D  Y  I  H  I  R  I  Q  Q  R  N  G<br> 61 GACCTGCTTCCTGCTGGCACTGAGGATTATATCCATATAAGAATTCAACAGAGAAACGGC<br> 41 R  K  T  L  T  T  V  Q  G  I  A  D  D  Y  D  K  K  K  L  V<br>121 AGGAAGACCCTTACTACTGTCCAAGGGATCGCTGATGATTACGATAAAAAGAAACTAGTG<br> 61 K  A  F  K  K  K  F  A  C  N  G  T  V  I  E  H  P  H  Y  G<br>181 AAGGCGTTTAAGAAAAAGTTTGCCTGCAATGGTACTGTAATTGAGCATCCGGAATATGGA<br> 81 E  V  I  Q  L  Q  G  D  Q  R  K  N  I  C  Q  F  L  V  E  I<br>241 GAAGTAATTCAGCTACAGGGTGACCAACGCAAGAACATATGCCAGTTCCTCGTAGAGATT<br>101 G  L  A  K  D  D  Q  L  K  V  H  G  F  -<br>301 GGACTGGCTAAGGACGATCAGCTGAAGGTTCATGGGTTTTAA | SEQ ID NO: 103 |
| B1961690.V1.3_AT | Homo sapiens eukaryotic translation initiation factor 3, subunit 5 epsilon, 47 kDa mRNA. |   1 ATGGCCACACCGGCGGTACCAGTAAGTGCTCCTCCGGCCACGCCAACCCCAGTCCCGGCG<br> 61 GCGGCCCCAGCCTCAGTTCCAGCGCCAACGCCAGCACCGGCTGCGGCTCCGGTTCCCGCT<br>121 GCCGCTCCAGCCTCATCCTCAGACCCGGCGGCAGCGGCGACTGCGACCGCGGCTCCCGGC<br>181 CAGCCCCCGGCCTCGGCGCCAGCCCCAGCGCAGACCCCGGCGCAGTCTTTGCCGGGTCCT<br>241 GCTCTCCCGGGCCCCTTCCCCGGCGGCCGCGTGGTCCGCCTGCACCCGGTCATTTTGGCC<br>301 TCCATCGTGGACAGCTACGAGCGACGCAACGAGGGCGCTGCCCGCGTTATCGGGACCCTG<br>361 CTCGGAACCGGTGACAAGCACTCTGTGGAAGTCACCAATTGCTTTTCAGTGCCACACAAC<br>421 GAGTCAGAAGATGAGGTGGCTGTTGACATGGAATTTGCTAAGAACATGTATGAATTGCAC<br>481 AAGAAGGTCTCTCCAAATGAGCTCATCCTGGGCTGGTACGCTACGGGCCATGACATCACA<br>541 GAGCACTCTGTGCTGATCCATGAGTACTACAGCCGGGAAGCCCCCAACCCCATTCACCTC<br>601 ACTGTGGACACGAGCCTCCAGAACGGCCGCATGAGCATCAAGGCCTATGTCAGCACTTTA<br>661 ATGGGTGTCCCTGGGAGGACCATGGGGGTGATGTTCACACCTCTGACAGTGAAATATGCA<br>721 TATTATGACACAGAACGCATCGGAGTTGACCTGATCATGAAGACCTGTTTTAGCCCCAAC<br>781 CGGGTGATCGGACTCTCAAGTGACTTGCAGCAAGTAGGAGGGGCGTCGGCTCGCATCCAG<br>841 GATGCCCTAAGCACAGTTGTTGCAGTACGCAGAGGATGTACTGTCTGGAAAGGTGTCAGCT<br>901 GACAATACAGTGGGCCGCTTCTTGATGAGTCTGGTTAACCAAGTACCCAAGATAGTTCCT<br>961 GATGACTTCGAGACCATGCTCAACAGCAACATCAATGACCTGCTGATGGTGACCTACTTG<br>1021 GCCAATCTCACACAATCACAAATTGCCCTCAATGAGAAACTCGTAAACCTGTAG | SEQ ID NO: 104 |
| | |   1 M  A  T  P  A  V  P  V  S  A  P  P  A  T  P  T  P  V  P  A<br>  1 ATGGCCACACCGGCGGTACCAGTAAGTGCTCCTCCGGCCACGCCAACCCCAGTCCCGGCG<br> 21 A  A  P  A  S  V  P  A  P  T  P  A  P  A  A  A  P  V  P  A<br> 61 GCGGCCCCAGCCTCAGTTCCAGCGCCAACGCCAGCACCGGCTGCGGCTCCGGTTCCCGCT<br> 41 A  A  P  A  S  S  S  D  P  A  A  A  A  T  A  A  P  G<br>121 GCCGCTCCAGCCTCATCCTCAGACCCGGCGGCAGCGGCGACTGCGACCGCGGCTCCCGGC<br> 61 Q  P  P  A  S  A  P  A  P  A  Q  T  P  A  Q  S  L  P  G  P<br>181 CAGCCCCCGGCCTCGGCGCCAGCCCCAGCGCAGACCCCGGCGCAGTCTTTGCCGGGTCCT<br> 81 A  L  P  G  P  F  P  G  G  R  V  V  R  L  H  P  V  I  L  A<br>241 GCTCTCCCGGGCCCCTTCCCCGGCGGCCGCGTGGTCCGCCTGCACCCGGTCATTTTGGCC<br>101 S  I  V  D  S  Y  E  R  R  N  E  G  A  A  R  V  I  G  T  L<br>301 TCCATCGTGGACAGCTACGAGCGACGCAACGAGGGCGCTGCCCGCGTTATCGGGACCCTG<br>121 L  G  T  G  D  K  H  S  V  E  V  T  N  C  F  S  V  P  H  N<br>361 CTCGGAACCGGTGACAAGCACTCTGTGGAAGTCACCAATTGCTTTTCAGTGCCACACAAC<br>141 E  S  E  D  E  V  A  V  D  M  E  F  A  K  N  M  Y  E  L  H<br>421 GAGTCAGAAGATGAGGTGGCTGTTGACATGGAATTTGCTAAGAACATGTATGAATTGCAC<br>161 K  K  V  S  P  N  E  L  I  L  G  W  Y  A  T  G  H  D  I  T<br>481 AAGAAGGTCTCTCCAAATGAGCTCATCCTGGGCTGGTACGCTACGGGCCATGACATCACA<br>181 E  N  S  V  L  I  H  E  Y  Y  S  R  E  A  P  N  P  I  H  L<br>541 GAGCACTCTGTGCTGATCCATGAGTACTACAGCCGGGAAGCCCCCAACCCCATTCACCTC<br>201 T  V  D  T  S  L  Q  N  G  R  M  S  I  K  A  Y  V  S  T  L<br>601 ACTGTGGACACGAGCCTCCAGAACGGCCGCATGAGCATCAAGGCCTATGTCAGCACTTTA<br>221 M  G  V  P  G  R  T  M  G  V  M  F  T  P  L  T  V  K  Y  A<br>661 ATGGGTGTCCCTGGGAGGACCATGGGGGTGATGTTCACACCTCTGACAGTGAAATATGCA<br>241 Y  Y  D  T  E  R  I  G  V  D  L  I  M  K  T  C  F  S  P  N<br>721 TATTATGACACAGAACGCATCGGAGTTGACCTGATCATGAAGACCTGTTTTAGCCCCAAC | SEQ ID NO: 105 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 261 R V I G L S S D L Q Q V G G A S A R I Q<br>781 CGGGTGATCGGACTCTCAAGTGACTTGCAGCAAGTAGGAGGGGCGTCGGCTCGCATCCAG<br>281 D A L S T V L Q Y A E D V L S G K V S A<br>841 GATGCCCTAAGCACAGTGTTGCAGTACGCAGAGGATGTACTGTCTGGAAAGGTGTCAGCT<br>301 D N T V G R F L M S L V N Q V P K I V P<br>901 GACAATACAGTGGGCCGCTTCTTGATGAGTCTGGTTAACCAAGTACCCAAGATAGTTCCT<br>321 D D F E T M L N S N I N D L L M V T Y L<br>961 GATGACTTCGAGACCATGCTAACAGCAACATCAATGACCTGCTGATGGTGACCTACTTG<br>341 A N L T Q S Q I A L N E K L V N L -<br>1021 GCCAATCTCACACAATCACAAATTGCCCTCAATGAGAAACTCGTAAACCTGTAG | |
| WBC016C12 | No homology | 1 TCCCCAGGCTGCCGAAGCGGAGTGCACGAACTTAACTGCTGCACCACCAGGCTGGCCCCT<br>61 TGATCCATTTCTTTTTTCTTTTTTGAAGAAGATTATCCCTGAGCTAACATCCACCCAA<br>121 TCCTCCTCTTTTTGCTGAGGAAGACTGGTCCTGAGCAAACATCCATGCCCATCCTCCTCT<br>181 ACTTTATATATGGGACGCCTACCACACGCATGGCTTGCCAAGTGGTGCCATATGGGCACCT<br>241 GGGATCCGAACTGGCGAACCCTGGGCCGCCCAAGCGGAACATGCGCTCTTAACTGCTGCG<br>301 CCACCCGGCCGGCCCCTATATGTTTCTTGACAGGGTAGATAATTTGTTTAGGGAACTACA<br>361 ATTCTGTTCTTTAACTATGTACCATAAAGAATGTGATTAAAGTACTTGAAAAGTAACTTC<br>421 TTCAAACTTAGTTTTTTATAAAATATGCAGATCTAAAAGTCACTGTCAAGATAAGTCTGA<br>481 ATTAGTTCTCTTATGGTCCTACTTCTAAAACTGAAGGTTTTGTGTGCAAAGGAATCCTTT<br>541 CTGGATAAGACGGGATTCCCTTTACCCTCTGTCCACGGGGCTTTATGTTAACTGTGAGGC<br>601 CGCATGTGTCCGTCACTGGCACCCCGGTCCCACCGGGATGTGTGGGAGCCTCCAGGCTGT<br>661 CCCAGTGTTAATTGTATTTACAGCAGGCCTACTAGACCAGCAGGAAGCATCGCACATGTC<br>721 ACATTGCACATGGGAGCTCAGGTCCTGAAGTCAGGCTTCTGTCTGTGCTGTCCTTCCTGT<br>781 TTGTGGGTTGCTGGTTCTCCACTGGGGTCCTTCAAAAGCAGCCCCACCCACACCTCCCCA<br>841 TTCTATTCACTCTGCTGCCTGTGTTAATATTTCTAAAAGATTTTTAATACATTAAACTCT<br>901 TACCTACGATTACTGTGGAATGGGATATACTGTTAAATTAGAA<br><br>NON CONGIGUOUS<br>1 TCTGTTCTTTAACTATGTACCATAAAGAATGTGATTAAAGTACTTGAAAAGTAACTTCTT<br>61 CAAACTTAGTTTTTTATAAAATATGCAGATCTAAAAGTCACTGTCAAGATAAGTCTGAAT<br>121 TAGTTCTCTTATGGTCCTACTTCTAAAACTGAAGGTTTTGTGTGCAAAGGAATCCTTTCT<br>181 GGATAAGACGGGATTCCCTTTACCCTCTGTCCACGGGGCTTTATGTTAACTGTGAGGCCG<br>241 CATGTGTCCGTCACTGGCACCCCGGTCCCACCGGGATGTGTGGGAGCCTCCAGGCTGTCC<br>301 CAGTGTTAATTGTATTTACAGCAGGCCTACTAGACCAGCAGGAAGCATCGCACATGTCAC<br>361 ATTGCACATGGGAGCTCAGGTCCTGAAGTCAGGCTTCTGTCTGTGCTGTCCTTCCTGTTT<br>421 GTGGGTTGCTGGTTCTCCACTGGGGTCCTTCAGAAGCAGCCCCACCCACACCTCCCCATT<br>481 CTATTCACTCTGCTGCCTGTGTTAATATTTCTAAAAGATTTTTAATACATTAAACTCTTA<br>541 CCTACGATTACTGTGGAATGGGATATACTGTTAATTAGAAATATATTTTTATTTAAAAAA<br>601 ATTATATTCAGAATACAACTAGAATAGACCAAAAAAAAAAAAA | SEQ ID NO: 106<br><br>SEQ ID NO: 107 |
| WBC032C03 | No homology | 1 GGGAGCCCTCACAGGGCTTCAGTGTAAGGGGACTGAGCCATCGAAAGCTCATTGCCAGA<br>61 AGGATACCATTTTTGGCTCTCCCTCTTCACTACCAGTACACAGTTTGACCCAGTGGCCAC<br>121 TGGTTCACAGTACGCCACGTCACTGCCATCCCATGAAACAGTTTGTTCCCAGGCCGTGCA<br>181 GAATCCTGGAGTGGCATGCTGACCAGAATGGCTTGCTTCTGCAGAGGATGCTGCCCCGTG<br>241 ACTTAGCTGCTGCCTCCAGCTTCTTGCTTAAGAACTTACTAAAGGGACTTCCTTCCCATT<br>301 AAAACCCCAATAGCAACTCTCCCTAAATTTGTTGATTCTCTGCTAGGCCTGAGAATCTGA<br>361 ATTAACATCTCTTGAAGCCAAACTCCGCCTCTTTGTGCTTTTTTTGCTTTGGATAAAGGAG<br>421 TTTTTCTTTAGAAACAGTGCCAAGAATGACAAGATATAAAAACTAATTTTAAAGAAAAT<br>481 GCCTAACAGGTTTTTAATACAGTAATCACTGTAATTATCACTTTCTTTTCTAGTTCCTTG<br>541 GTTTTCAGCTCAGGCTGCATTCTCTAACTCATACTGTGAAGAAAGAGGTGTTTTGATTC<br>601 AGAAATATATGAAATTCTACATAGTCTTAATTTGTAAAAAATAAAGAAAATTCCTTAACCT<br>661 TTAAAAAAAAAAAAAAAAAA | SEQ ID NO: 108 |
| WBC028007_V1.3_AT | Human guanylate binding protein isoform II (GBP2) mRNA | 1 AGTAAAAGTCCACAGTTACCGTGAGAGAAAAAAAGAGGAGAAAGCAGTGCAGCCAAACTC<br>61 GGAAGAAAAGAGAGGAGGAAAAGGACTCGACTTTCACATTGGAACAACCTTCTTTCAGT<br>121 GCTAAGGCTCTCTGATCTGGGGAACAACACCTGGACATGGCTCCAGAGATCAACCTTGCCG<br>181 GGCCCAATGAGCCTCATTGATAACACTAAAGGGCAGCTGGTGGTGAATCAGAAGCTCTG<br>241 AAGATCTATCTGCAATTACGCAGCCTGTGGTGGTGGCGATTGTGGGCCTCTATCGC<br>301 ACAGGCAAATCCTACCTGATGAACAAGCTGGCTGGGAAGAAAACGGCTTCTCTCTAGGC<br>361 TCCACAGTGAAGTCTCACACCCAAGGGAATCTGATGTGGTGTTGCCTCATCCCAAGAAG<br>421 CCAGAACACACCCTAGTTCTGCTCGACACTGAGGGCCTGGGAGATATAGAGAAGGGTGAC<br>481 AATGAGAATGACTCCTGGATCTTTGCCTTGGCCATCCTCCTGAGCAGCACCTTCGTGTAC<br>541 AATAGCATGGGAACCATCAACCAGCAGGCCATGGACCAACTGCACTACGTGACAGAGCTG<br>601 ACAGAGCGAATCAGGGCAAATCCTCACCCAGTAACAGTGAGCTTGAAGACTCAGCTGAC<br>661 TTCGTGAGCTTCTTTCCAACCTTTGTGTGGACTCTGAGAGATTTCTCCCTGGAGCTAGAA<br>721 GCCAATGGAGAACCCATCACTGCTGACGAGTACCTGGAGCTGTCACTGAAGCTAAAGAA<br>781 GGTACTGATGAAAAAGCAAAAGCTTTAATGAACTCGGTTGTGCATCCGAAAGTTCTTC<br>841 CCAAAGAAGAAGTGCTTCATCTTTGACGTCCCGCTCCACGGAAGTACCTTGTCCAACTG<br>901 GAGAAGCTACAGGAGGAAGATCTGGACCCTGAATTCAGAGAACAAGTTGCAGACTTCTGC<br>961 TCCTACATCTTCAGCCATTCCAAAGCCAAGACTCTCAGGCGGCATCATAGTCAATGGG<br>1021 CCTCGTCTGGAGAGCCTGGTGCTGACCTATGTCAATGCCATCAGCAGTGGGGATCTTCCC<br>1081 TGCATGGAGAATGCAGTCCTGGCCTTGGCCCAGATAGAGAACTCGGCCGCAGTACAAAAG<br>1141 GCCGTGGCCCACTATGATCAGCAGATGGGCCAGAGGGTGAAGCTGCCCACGGAAACCCTC | SEQ ID NO: 109 |

TABLE 1-continued

| Gene | GenBank Homology | DNA SEQUENCE/DEDUCED AMINO ACID SEQUENCE | SEQUENCE IDENTIFIER: |
|------|------------------|------------------------------------------|----------------------|
| | | 1201 CAGGAGCTTCTGGACCTGCACAGGGCCAACGAGAAAGAGGCCATTGAAGTCTTCATGAAA<br>1261 AATTCTTTCAAGGATGTGGAACAAAAGTTCCAGAAGGAATTAGGGGCCCAGTTAGAAGCA<br>1321 AAGCGAGATGACTTTTGTAAGCAGAACATGCAAGCGTCATCAGATCGTTGCATGGCATTA<br>1381 CTTCAGGATATTTTTGGTCCTCTAGAAGAAGAGGTGAAGCAAAGGGGCATTTTCTAACCG<br>1441 GGAGGTTATCATCTCTTTATTCAGAAGAAACAGGAGCTGAAGAATAAGTACTACCAGGTG<br>1501 CCCAGGAAGGGGATACAGGCAGAGGACATGCTGAAGAAGTACTTGGAATCCAAGGAAGAC<br>1561 GTGGCTGATGCGCTTCTCCGGACTGACCAGTCACTCTCAGAAAAGGAAAAGGAGATTGAA<br>1621 GTGGAACGTATAAAGGCTGAATCTGCAGAAGCTGCAACGAAAATGTTGGAGGAAATCCAA<br>1681 AAGAAGAATCAGCAGATGATGGAACAGAAAGAAAAGAGTTATCAGGAACACGTGAAACAA<br>1741 TTGACTGAGAAGATGGAGAGAGATAGGGCCCAGCTGCTGGCAGAGCAGGAGAGGACTCTC<br>1801 GCTCTTAAACTTCAGGAACAGGAACGACTTCTCAAGGAAGGATTCCAGAACGAGAGCAGG<br>1861 AAACTTCAAAAAGACATATGGGATATCCAGATGAGAAGCAAATCATTGGAGCCAATATGT<br>1921 AACATACTCTAAAAGTCCAAGGAGCAAAATTTGCCTGTCCAGCTCCCTCTCCCCAAGAAA<br>1981 CAACATGAATGAGCAACTTCAGAGTGTCAAACAACTGCCATTAAACTTAACTCAAAATCA<br>2041 TGATGCTTCCATTTTTGTTGAGCTATAAAATTTGCAAAGTTTGCAGTAAAAAGGTTAAGT<br>2101 ATGAGGTCAATGTTTT | |
| | |   1 M   A   P   E   I   N   L   P   G   P   M   S   L   I   D   N   T   K   G   Q<br>   1 ATGGCTCCAGAGATCAACTTGCCGGGGCCCAATGAGCCTCATTGATAACACTAAAGGGCAG<br>  21 L   V   V   N   P   E   A   L   K   I   L   S   A   I   T   Q   P   V   V   V<br>  61 CTGGTGGTGAATCCAGAAGCTCTGAAGATCCTATCTGCAATTACGCAGCCTGTGGTGGTG<br>  41 V   A   I   V   G   L   Y   R   T   G   K   S   Y   L   M   N   K   L   A   G<br> 121 GTGGCGATTGTGGGCCTCTATCGCACAGGCAAATCCTACCTGATGAACAAGCTGGCTGGG<br>  61 K   K   N   G   F   S   L   G   S   T   V   K   S   H   T   K   G   I   W   M<br> 181 AAGAAAAACGGCTTCTCTCTAGGCTCCACAGTGAAGTCTCACACCAAGCGAATCTCCATG<br>  81 W   C   V   P   H   P   K   K   P   E   H   T   L   V   L   L   D   T   E   G<br> 241 TGGTGTGTGCCTCATCCCAAGAAGCCAGAACACACCCTAGTTCTGCTCGACACTGAGGGC<br> 101 L   G   D   I   E   K   G   D   N   E   N   D   S   W   I   F   A   L   A   I<br> 301 CTGGGAGATATAGAGAAGGGTGACAATGAGAATGACTCCTGGATCTTTGCCTTGGCCATC<br> 121 L   L   S   S   T   F   V   Y   N   S   M   G   T   I   N   Q   Q   A   M   D<br> 361 CTCCTGAGCAGCACCTTCGTGTACAATAGCATGGGAACCATCAACCAGCAGGCCATGGAC<br> 141 Q   L   H   Y   V   T   E   L   T   E   R   I   R   A   K   S   P   S   N<br> 421 CAACTGCACTACGTGACAGAGCTGACAGAGCGAATCAGGGCAAAATCCTCACCCAGTAAC<br> 161 S   E   L   E   D   S   A   D   F   V   S   F   F   P   T   F   V   W   T   L<br> 481 AGTGAGCTTGAAGACTCAGCTGACTTCGTGAGCTTCTTTCCAACCTTTGTGTGGACTCTG<br> 181 R   D   F   S   L   E   L   E   A   N   G   E   P   I   T   A   D   E   Y   L<br> 541 AGAGATTTCTCCCTGGAGCTAGAAGCCAATGGAGAACCCATCACTGCTGACGAGTACCTG<br> 201 E   L   S   L   K   L   K   K   G   T   D   E   K   S   K   S   F   N   E   P<br> 601 GAGCTGTCACTGAAGCTAAAGAAAGGTACTGATGAAAAAAGCAAAAGCTTTAATGAACCT<br> 221 R   L   C   I   R   K   F   F   P   K   K   K   C   F   I   F   D   R   P   A<br> 661 CGGTTGTGCATCCGAAAGTTCTTCCCAAAGAAGAAGTGCTTCATCTTTGACCGTCCCGCT<br> 241 P   R   K   Y   L   V   Q   L   E   K   L   Q   E   E   D   L   D   P   E   F<br> 721 CCCAGGAAGTACCTTGTCCAACTGGAGAAGCTACAGGAGGAAGATCTGGACCCTGAATTC<br> 261 R   E   Q   V   A   D   F   C   S   Y   I   F   S   H   S   K   A   K   T   L<br> 781 AGAGAACAAGTTGCAGACTTCTGCTCCTACATCTTCAGCCATTCCAAAGCCAAGACTCTC<br> 281 S   G   G   I   I   V   N   G   P   R   L   E   S   L   V   L   T   Y   V   N<br> 841 TCAGGCGGCATCATAGTCAATGGGCCTCGTCTGCAGAGCCTGGTGCTGACCTATGTCAAT<br> 301 A   I   S   S   G   D   L   P   C   M   K   N   A   V   L   A   L   A   Q   I<br> 901 GCCATCAGCAGTGGGGATCTTCCCTGCATGGAGAATGCAGTCCTGGCCTTGGCCCAGATA<br> 321 E   N   S   A   A   V   Q   K   A   V   A   H   Y   D   Q   Q   N   G   Q   R<br> 961 GAGAACTCGGCCGCAGTACAAAAGGCCGTGGCCCACTATGATCAGCAGATGGGCCAGAGG<br> 341 V   K   L   P   T   E   T   L   Q   E   L   L   D   L   H   R   A   N   E   K<br>1021 GTGAAGCTGCCCACGGAAACCCTCCAGGAGCTTCTGGACCTGCACAGGGCCAACGAGAAA<br> 361 E   A   I   E   V   F   M   K   N   S   F   K   D   V   E   Q   K   F   Q   K<br>1081 GAGGCCATTGAAGTCTTCATGAAAAATTCTTTCAAGGATGTGGAACAAAAGTTCCAGAAG<br> 381 E   L   G   A   Q   L   E   A   K   R   D   D   F   C   K   Q   N   M   Q   A<br>1141 GAATTAGGGGCCCAGTTAGAAGCAAAGCGAGATGACTTTTGTAAGCAGAACATGCAAGCG<br> 401 S   S   D   R   C   M   A   L   L   Q   D   I   F   G   P   L   E   E   V<br>1201 TCATCAGATCGTTGCATGGCATTACTTCAGGATATTTTTGGTCCTCTAGAAGAAGAGGTG<br> 421 K   Q   G   A   F   S   K   P   G   G   Y   H   L   F   I   Q   K   K   Q   E<br>1261 AAGCAAGGGGCATTTTCTAAACCGGGAGGTTATCATCTCTTTATTCAGAAGAAACAGGAG<br> 441 L   K   N   K   Y   Y   Q   V   P   R   K   G   I   Q   A   E   D   M   L   K<br>1321 CTGAAGAATAAGTACTACCAGGTGCCCAGGAAGGGGATACAGGCAGAGGACATGCTGAAG<br> 461 K   Y   L   E   S   K   E   D   V   A   D   A   L   L   R   T   D   Q   S   L<br>1381 AAGTACTTGGAATCCAAGGAAGACGTGGCTGATGCGCTTCTCCGGACTGACCAGTCACTC<br> 481 S   E   K   E   K   E   I   E   V   H   R   I   K   A   E   S   A   E   A   A<br>1441 TCAGAAAAGGAAAAGGAGATTGAAGTGGAACGTATAAAGGCTGAATCTGCAGAAGCTGCA<br> 501 T   K   M   L   E   E   I   Q   K   K   N   Q   Q   M   M   E   Q   K   E   K<br>1501 ACGAAAATGTTGGAGGAAATCCAAAAGAAGAATCAGCAGATGATGGAACAGAAAGAAAAG<br> 521 S   Y   Q   E   H   V   K   Q   L   T   E   K   M   E   R   D   R   A   Q   L<br>1561 AGTTATCAGGAACACGTGAAACAATTGACTGAGAAGATGGAGAGAGATAGGGCCCAGCTG<br> 541 L   A   E   Q   E   R   T   L   A   L   K   L   Q   E   Q   E   R   L   L   K<br>1621 CTGGCAGAGCAGGAGAGGACTCTCGCTCTTAAACTTCAGGAACAGGAACGACTTCTCAAG | SEQ ID NO: 110 |

TABLE 1-continued

| Gene | GenBank Homology | DNA SEQUENCE/DEDUCED AMINO ACID SEQUENCE | SEQUENCE IDENTIFIER: |
|---|---|---|---|
| | | 561  E  G  F  Q  N  E  S  R  K  L  Q  K  D  I  W  D  I  Q  M  R<br>1681 GAAGGATTCCAGAACGAGAGCAGGAAACTTCAAAAGACATATGGGATATCCAGATGAGA<br>581  S  K  S  L  E  P  I  C  N  I  L  -<br>1741 AGCAAATCATTGGAGCCAATATGTAACATACTCTAA | |
| WBC010B02_V1.3_AT | *Homo sapiens* C-type lectin protein CLL-1 mRNA, complete cds. | 1 GGGTGATTGGTACAGTAGGTTTATAAACAGAAGTTTAAACTTGTAAGCTTAAGCTTCCGT<br>61 TTATAAACAGAAGTTTAAAATTATAGGTCCTGTTTAACATTCAGCTCTGTTAACTCACTC<br>121 ATCTTTTTGTGTTTTTACACTTTGTCAAGATTTCTTTACATATTCATCAATGTCTGAAGA<br>181 AGTTACTTATGCAGATCTTCAATTCCAGAACTCCAGTGAGATGGAAAAAATCCCAGAAAT<br>241 TGGCAAATTGGGGAAAAAGCACCTCCAGCTCCCTCTCATGTATGGCGTCCAGCAGCCTT<br>301 GTTTCTGACTCTTCTGTGTCTTCTGCTGCTGACTGGACTGGGAGTCTTAGGAAGCATGTT<br>361 TTATATAACTTTGAAGACAGAAGTGGGAAAATTGAATGAACTACAAAATTTTAAAGAAGA<br>421 ACTTCAGAGAAATATTTCTATACAACTGATGCATAACATGAATAATTCTGAGAAGATCAG<br>481 GAACCTCTCTATCACACTGCAAGAAATAGCCACCAAATTTTGTCATGAGCTGTATAGAAA<br>541 CAATCAAGAGCACAAATGTAAACCTTGCCCAAAGCAATGGATATGGCATGAAGACAGCTG<br>601 TTATTTCCTAAGTGATGATGTCCAAACATGGCAGGAGAGTAAAATGGCCTGTGCTGCTCA<br>661 GAATGCCAGCCTGTTGAAGATAAACAACAAAAATGCATTGGAATTTATAAAATCCCAGAG<br>721 TAGATCATATGACTATTGGCTGGGATTATCTCCTGAAGAAGATTCCACTCGTGGTATGAG<br>781 AGTGGATAATATAATCAACTCCTCTGCCTGGGTTATAAGAAACGCACCTGACTTAAATAA<br>841 CATGTATTGTGGATATATAAATAGACTATATGTTCAATATTATCACTGCACTTATAAACA<br>901 AAGAATGATATGTGAGAAGATGGCCAATCCAGTGCAGCTTGGTTCTACATATTTTAGGGA<br>961 GGCATGAGGCATCAATCAAATACATTGAAGGAGTGTAGGGGGTGGGGGTTCTAGGCTATA<br>1021 GGTAAATTTAAATATTTTCTGGTTGACAATTAGTTGAGTTTGTCTGAAGACCTGGGATTT<br>1081 TATCATGCAGATGAACATCCAGGTAGCAAGCTTCAGAGAGAATAGACAAGTGAATGTTAA<br>1141 TGCCAGAGAGGTATAATGAAGCATGTCCCACCTCCCACTTTCCATCATGGCCTGAACCCT<br>1201 GGAGGAAGAGGAAGTCCATTCAGATAGTTGTGGGGGGCCTTCGAATTTTCATTTTCATTT<br>1261 ACGTTCTTCCCCTTCTGGCCAAGATTTGCCAGAGGCAACATCAAAAACCAGCAAATTTTA<br>1321 ATTTTGTCCCACAGCGTTGCTAGGGTGGCATGGCTCCCCATCTCGGGTCCATCCTATACT<br>1381 TCCATGGGACTCCCTATGGCTGAAGGCCTTATGAGTCAAAGGACTTATAGCCAATTGATT<br>1441 GTTCTAGGCCAGGTAAGAATGGATATGGACATGCATTTATTACCTCTTAAAATTATTATT<br>1501 TTAAGTAAAAGCCAATAAACAAAAACGAAAAGGCAAAAAAAAAAAAAAAAAAAAAAAAAA<br>1561 AAAAAA | SEQ ID NO: 111 |
| | | 1  M  S  E  E  V  T  Y  A  D  L  Q  F  Q  N  S  S  E  M  E  K<br>1 ATGTCTGAAGAAGTTACTTATGCAGATCTTCAATTCCAGAACTCCAGTGAGATGGAAAAA<br>21  I  P  E  I  G  K  F  G  E  K  A  P  P  A  P  S  H  V  W  R<br>61 ATCCCAGAAATTGGCAAATTTGGGGAAAAAGCACCTCCAGCTCCCTCTCATGTATGGCGT<br>41  P  A  A  L  F  L  T  L  L  C  L  L  L  L  T  G  L  G  V  L<br>121 CCAGCAGCCTTGTTTCTGACTCTTCTGTGTCTTCTGCTGCTGACTGGACTGGGAGTCTTA<br>61  G  S  M  F  Y  I  T  L  K  T  E  V  G  K  N  E  L  Q  N<br>181 GGAAGCATGTTTTATATAACTTTGAAGACAGAAGTGGGAAAATTGAATGAACTACAAAAT<br>81  F  K  E  E  L  Q  R  N  I  S  I  Q  L  M  H  N  M  N  S<br>241 TTTAAAGAAGAACTTCAGAGAAATATTTCTATACAACTGATGCATAACATGAATAATTCT<br>101  E  K  I  R  N  L  S  I  T  L  Q  E  I  A  T  K  F  C  H  E<br>301 GAGAAGATCAGGAACCTCTCTATCACACTGCAAGAAATAGCCACCAAATTTTGTCATGAG<br>121  L  Y  R  N  N  Q  E  H  K  C  K  P  C  P  K  Q  W  I  W  H<br>361 CTGTATAGAAACAATCAAGAGCACAAATGTAAACCTTGCCCAAAGCAATGGATATGGCAT<br>141  E  D  S  C  Y  F  L  S  D  D  V  Q  T  W  Q  E  S  K  M  A<br>421 GAAGACAGCTGTTATTTCCTAAGTGATGATGTCCAAACATGGCAGGAGAGTAAAATGGCC<br>161  C  A  A  Q  N  A  S  L  L  K  I  N  N  K  N  A  L  E  F  I<br>481 TGTGCTGCTCAGAATGCCAGCCTGTTGAAGATAAACAACAAAAATGCATTGGAATTTATA<br>181  K  S  Q  S  R  S  Y  D  Y  W  L  G  L  S  P  E  E  D  S  T<br>541 AAATCCCAGAGTAGATCATATGACTATTGGCTGGGATTATCTCCTGAAGAAGATTCCACT<br>201  R  G  M  R  V  D  N  I  I  N  S  S  A  W  V  I  R  N  A  P<br>601 CGTGGTATGAGAGTGGATAATATAATCAACTCCTCTGCCTGGGTTATAAGAAACGCACCT<br>221  D  L  N  N  M  Y  C  G  Y  I  N  R  L  Y  V  Q  Y  Y  H  C<br>661 GACTTAAATAACATGTATTGTGGATATATAAATAGACTATATGTTCAATATTATCACTGC<br>241  T  Y  K  Q  R  M  I  C  E  K  M  A  N  P  V  Q  L  G  S  T<br>721 ACTTATAAACAAAGAATGATATGTGAGAAGATGGCCAATCCAGTGCAGCTTGGTTCTACA<br>261  Y  F  R  E  A  -<br>781 TATTTTAGGGAGGCATGA | SEQ ID NO: 112 |
| B1961567.V1.3_AT | *Homo sapiens* leucine aminopeptidase 3, mRNA. | 1 GGCCGAGCCGACAAGATGTTCTTGCTGCCTCTTCCGGCTGCGGGGCGAGTAGTCGTCCGA<br>61 CGTCTGGCCGTGAGACGTTTCGGGAGCCGGAGTCTCTCCACCGCAGACATGACGAAGGGC<br>121 CTTGTTTTAGGAATCTATTCCAAAGAAAAAGAAGATGATGTGCCACAGTTCACAAGTGCA<br>181 GGAGAGAATTTTGATAAATTGTTAGCTGGAAAGTCGAGAGAGACTTTGAACATATCTGGA<br>241 CCACCTCTGAAGGCAGGGAAGACTCGAACCCTTTTATGGTCTGCATCAGGACTTCCCCAGC<br>301 GTGGTGCTAGTTGGCCTCGGCAAAAAGGCAGCTGGAATCGACGAACAGGAAAACTGGCAT<br>361 GAAGGCAAAGAAAACATCAGAGCTGCTGTTGCAGCGGGGTGCAGCAGATTCAAGACCTG<br>421 GAGCTCTCGTCTGTGGAGGTGGATCCCTGTGGAGACGCTCAGGCTGCTGCGGAGGGAGCG<br>481 GTGCTTGGTCTCTATGAATACGATGACCTAAAGCAAAAAAGAAGATGGCTGTGTCGGCA<br>541 AAGCTCTATGGAAGTGGGGATCAGGAGGCCTGGCAGAAAGGAGTCCTGTTTGCTTCTGGG<br>601 CAGAACTTGGCACGCCAATTGATGGAGACGCCAGCCAATGAGATGACGCCAACCAGATTT<br>661 GCCGAAATTATTGAGAAGAATCTCAAAAGTGCTAGTAGTAAAACCGAGGTCCATATCAGA | SEQ ID NO: 113 |

TABLE 1-continued

| Gene | GenBank Homology | DNA SEQUENCE/DEDUCED AMINO ACID SEQUENCE | SEQUENCE IDENTIFIER: |
|------|------------------|------------------------------------------|----------------------|
| | | 721  CCCAAGTCTTGGATTGAGGAACAGGCAATGGGATCATTCCTCAGTGTGGCCAAAGGATCT | |
| | | 781  GACGAGCCCCCAGTCTTCTTGGAAATTCACTACAAAGGCAGCCCCAATGCAAACGAACCA | |
| | | 841  CCCCTGGTGTTTGTTGGGAAAGGAATTACCTTTGACAGTGGTGGTATCTCCATCAAGGCT | |
| | | 901  TCTGCAAATATGGACCTCATGAGGGCTGACATGGGAGGAGCTGCAACTATATGCTCAGCC | |
| | | 961  ATCGTGTCTGCTGCAAAGCTTAATTTGCCCATTAATATTATAGGTCTGGCCCCTCTTTGT | |
| | | 1021 GAAAATATGCCCAGCGGCAAGGCCAACAAGCCGGGGGATGTTGTTAGAGCCAAAAACGGG | |
| | | 1081 AAGACCATCCAGGTTGATAACACTGATGCTGAGGGGAGGCTCATACTGGCTGATGCGCTC | |
| | | 1141 TGTTACGCACACACGTTTAACCCGAAGGTCATCCTCAATGCCGCCACCTTAACAGGTGCC | |
| | | 1201 ATGGATGTAGCTTTGGGATCAGGTGCCACTGGGGTCTTTACCAATTCATCCTGGCTCTGG | |
| | | 1261 AACAAACTCTTCGAGGCCAGCATTGAAACAGGGGACCGCGTCTGGAGGATGCCTCTCTTT | |
| | | 1321 GACCATTATACTAGACAGGTTGTCGATTGCCAACTTGCTGATGTTAATAACATCGGAAAG | |
| | | 1381 TATAGATCTGCAGGAGCATGTACAGCTGCAGCATTCCTGAAGGAATTTGTGACTCATCCT | |
| | | 1441 AAGTGGGCGCATTTAGACATAGCAGGAGTGATGACTAACAAAGATGAGATTCCGTATCTG | |
| | | 1501 CGTAAAGGCATGACCGGGAGGCCCACGAGGACCCTGATAGAGTTCTTGCTTCGGTTCAGT | |
| | | 1561 CAAGACAAAGCTTAGTTCAGATACTCTAAAATGCCTTCATTCTGTCTTAAATTGGACAGT | |
| | | 1621 TGAACTTAAAAGGTTTTTGAATAAATGGATGAAAATCTTTTAACGGAGACAAAGGATGGT | |
| | | 1681 ATTTAAAAATGTAGAACACAATGAAATTTGTATGCCTTGATTTTTTTTTCATTTCACACA | |
| | | 1741 AAGATTTATAAAGGTAAAGTTAATATCTTACTTGATAAGGATTTTTAAGATACTCTATAA | |
| | | 1801 ATGATTAATTTTTAAAAACTACCTAATCATTTTTCAGAGTGTATGTTTTTAATTGAGTG | |
| | | 1861 AAATTGTATTTCGGATTTGTGATGCTAGGAACATGAGCAAACTGAAAATTACTATGCACT | |
| | | 1921 TGTCAGAAACAATAAATGCAACTTGTTGTGCAAAAAAAAAAAAAAAAAAA | |
| | |    1  M  F  L  L  P  L  P  A  A  G  R  V  V  V  R  R  L  A  V  R    | SEQ ID |
| | |    1  ATGTTCTTGCTGCCTCTTCCGGCTGCGGGGCGAGTAGTCGTCCGACGTCTGGCCGTGAGA | NO: |
| | |   21  R  F  G  S  R  S  L  S  T  A  D  M  T  K  G  L  V  L  G  I    | 114 |
| | |   61  CGTTTCGGGAGCCGGAGTCTCTCCACCGACATGACGAAGGGCCTTGTTTTAGGAATC | |
| | |   41  Y  S  K  E  K  H  D  D  V  P  Q  F  T  S  A  G  E  N  F  D | |
| | |  121  TATTCCAAAGAAAAAGAAGATGATGTGCCACAGTTCACAAGTGCAGGAGAGAATTTTGAT | |
| | |   61  K  L  L  A  G  K  L  R  E  T  L  N  I  S  G  P  P  L  K  A | |
| | |  181  AAATTGTTAGCTGGAAAGCTGAGAGAGACTTTGAACATATCTGGACCACCTCTGAAGGCA | |
| | |   81  G  K  T  R  T  F  Y  G  L  H  Q  D  F  P  S  V  V  L  V  G | |
| | |  241  GGGAAGACTCGAACCTTTTATGGTCTGCATCAGGACTTCCCCAGCGTGGTGCTAGTTGGC | |
| | |  101  L  G  K  K  A  A  G  I  D  E  Q  E  N  W  H  E  G  K  E  N | |
| | |  301  CTCGGCAAAAAGGCAGCTGGAATCGACGAACAGGAAAACTGGCATGAAGGCAAAGAAAAC | |
| | |  121  I  R  A  A  V  A  A  G  C  R  Q  I  Q  D  L  E  L  S  S  V | |
| | |  361  ATCAGAGCTGCTGTTGCAGCGGGGTGCAGGCAGATTCAAGACCTGGAGCTCTCGTCTGTG | |
| | |  141  E  V  D  P  C  G  D  A  Q  A  A  A  E  G  A  V  L  G  L  Y | |
| | |  421  GAGGTGGATCCCTGTGGAGACGCTCAGGCTGCTGCGGAGGGAGCGGTGCTTGGTCTCTAT | |
| | |  161  E  Y  D  D  L  K  Q  K  K  K  M  A  V  S  A  K  L  Y  G  S | |
| | |  481  GAATACGATGACCTAAAGCAAAAAAAGAAGATGGCTGTGTCGGCAAAGCTCTATGGAAGT | |
| | |  181  G  D  Q  E  A  W  Q  K  G  V  L  F  A  S  G  Q  N  L  A  R | |
| | |  541  GGGGATCAGGAGGCCTGGCAGAAAGGAGTCCTGTTTGCTTCTGGGCAGAACTTGGCACGC | |
| | |  201  Q  L  M  E  T  P  A  N  E  M  T  P  T  R  F  A  E  I  I  E | |
| | |  601  CAATTGATGGAGACGCCAGCCAATGAGATGACGCCAACCAGATTTGCCGAAATTATTGAG | |
| | |  221  K  N  L  K  S  A  S  S  K  T  E  V  H  I  R  P  K  S  W  I | |
| | |  661  AAGAATCTCAAAAGTGCTAGTAGTAAAACCGAGGTCCATATCAGACCCAAGTCTTGGATT | |
| | |  241  E  E  Q  A  M  G  S  F  L  S  V  A  K  G  S  D  E  P  P  V | |
| | |  721  GAGGAACAGGCAATGGGATCATTCCTCAGTGTGGCCAAAGGATCTGACGAGCCCCCAGTC | |
| | |  261  F  L  E  I  H  Y  K  G  S  P  N  A  N  E  P  P  L  V  F  V | |
| | |  781  TTCTTGGAAATTCACTACAAAGGCAGCCCCAATGCAAACGAACCACCCCTGGTGTTTGTT | |
| | |  281  G  K  G  I  T  F  D  S  G  G  I  S  I  K  A  S  A  N  M  D | |
| | |  841  GGGAAAGGAATTACCTTTGACAGTGGTGGTATCTCCATCAAGGCTTCTGCAAATATGGAC | |
| | |  301  L  M  R  A  D  M  G  G  A  A  T  I  C  S  A  I  V  S  A  A | |
| | |  901  CTCATGAGGGCTGACATGGGAGGAGCTGCAACTATATGCTCAGCCATCGTGTCTGCTGCA | |
| | |  321  K  L  N  L  P  I  N  I  I  G  L  A  P  L  C  E  N  M  P  S | |
| | |  961  AAGCTTAATTTGCCCATTAATATTATAGGTCTGGCCCCTCTTTGTGAAAATATGCCCAGC | |
| | |  341  G  K  A  N  K  P  G  D  V  V  R  A  K  N  G  K  T  I  Q  V | |
| | | 1021  GGCAAGGCCAACAAGCCGGGGGATGTTGTTAGAGCCAAAAACGGGAAGACCATCCAGGTT | |
| | |  361  D  N  T  D  A  E  G  R  L  I  L  A  D  A  L  C  Y  A  H  T | |
| | | 1081  GATAACACTGATGCTGAGGGGAGGCTCATACTGGCTGATGCGCTCTGTTACGCACACACG | |
| | |  381  F  N  P  K  V  I  L  N  A  A  T  L  T  G  A  M  D  V  A  L | |
| | | 1141  TTTAACCCGAAGGTCATCCTCAATGCCGCCACCTTAACAGGTGCCATGGATGTAGCTTTG | |
| | |  401  G  S  G  A  T  G  V  F  T  N  S  S  W  L  W  N  K  L  F  K | |
| | | 1201  GGATCAGGTGCCACTGGGGTCTTTACCAATTCATCCTGGCTCTGGAACAAACTCTTCGAG | |
| | |  421  A  S  I  E  T  G  D  R  V  W  R  M  P  L  F  D  H  Y  T  R | |
| | | 1261  GCCAGCATTGAAACAGGGGACCGCGTCTGGAGGATGCCTCTCTTTGACCATTATACTAGA | |
| | |  441  Q  V  V  D  C  Q  L  A  D  V  N  N  I  G  K  Y  R  S  A  G | |
| | | 1321  CAGGTTGTCGATTGCCAACTTGCTGATGTTAATAACATCGGAAAGTATAGATCTGCAGGA | |

TABLE 1-continued

| Gene | GenBank Homology | DNA SEQUENCE/DEDUCED AMINO ACID SEQUENCE | SEQUENCE IDENTIFIER: |
|------|------------------|------------------------------------------|----------------------|
| | | 461 A C T A A A F L K E F V T H P K W A H L<br>1381 GCATGTACAGCTGCAGCATTCCTGAAGGAATTTGTGACTCATCCTAAGTGGGCGCATTTA<br>481 D I A G V M T N K D E I P Y L R K G M T<br>1441 GACATAGCAGGAGTGATGACTAACAAAGATGAGATTCCGTATCTGCGTAAAGGCATGACC<br>501 G R P T R T L I E F L L R F S Q D K A -<br>1501 GGGAGGCCCACGAGGACCCTGATAGAGTTCTTGCTTCGGTTCAGTCAAGACAAAGCTTAG | |

TABLE 2

| Probe Set Name | Probe Sequence | Sequence Identifier |
|----------------|----------------|---------------------|
| B1961054.V1.3_at | CAACGTGTTGAGATCATTGCCACAA | SEQ ID NO: 115 |
| B1961054.V1.3_at | GAATCCAGAGTCCAAGACCGTCAAG | SEQ ID NO: 116 |
| B1961054.V1.3_at | GGTCTAAAAGATCTCCTCGAACACT | SEQ ID NO: 117 |
| B1961054.V1.3_at | GGTACTACTGATACGGATGGCCCAA | SEQ ID NO: 118 |
| B1961054.V1.3_at | GCCATCATTTCCCTGCATACAGTAT | SEQ ID NO: 119 |
| B1961054.V1.3_at | ATATGTCAAGCCCTAATTGTCCCCG | SEQ ID NO: 120 |
| B1961054.V1.3_at | TAATTGTCCCCGGATTGCAGTTCTC | SEQ ID NO: 121 |
| B1961054.V1.3_at | GTTCTCCTAAGATGACCAACCAGTC | SEQ ID NO: 122 |
| B1961054.V1.3_at | AATTAGCTGCTACTACTCCTGCAGG | SEQ ID NO: 123 |
| B1961054.V1.3_at | ATGGTTCATCATCCTGAGCTGTTCA | SEQ ID NO: 124 |
| B1961054.V1.3_at | TCAGTAGTAACTCTGCCTTGGCACT | SEQ ID NO: 125 |
| B1961434.V1.3_at | GAAAGATCTTCACTCCATGGACTTC | SEQ ID NO: 126 |
| B1961434.V1.3_at | TCACTCCATGGACTTCTACTGCCAT | SEQ ID NO: 127 |
| B1961434.V1.3_at | AAGGAGCCCATATTCTTCCAATGGT | SEQ ID NO: 128 |
| B1961434.V1.3_at | TTCTTCCAATGGTTATATACACAAA | SEQ ID NO: 129 |
| B1961434.V1.3_at | GAAGTCTTAGATGTACATATTTCTT | SEQ ID NO: 130 |
| B1961434.V1.3_at | CATATTTCTTACATTGTTTTCAGTG | SEQ ID NO: 131 |
| B1961434.V1.3_at | GTGTTTATGGAATAACTTACGTGAT | SEQ ID NO: 132 |
| B1961434.V1.3_at | GTACTACACATGAATGACCAATAGG | SEQ ID NO: 133 |
| B1961434.V1.3_at | GAAATCTAGATATATGTTCTGCATG | SEQ ID NO: 134 |
| B1961434.V1.3_at | ATATGTTCTGCATGATATGTAAGAC | SEQ ID NO: 135 |
| B1961434.V1.3_at | AAATATGCTGGATGTTTTTCAAAAT | SEQ ID NO: 136 |
| B1961434.V1.3_s_at | GCACTATACTATAAACTATGCTGAG | SEQ ID NO: 137 |
| B1961434.V1.3_s_at | AACTATGCTGAGGTGCTACATTCTT | SEQ ID NO: 138 |
| B1961434.V1.3_s_at | GCTGAGGTGCTACATTCTTAGTAAA | SEQ ID NO: 139 |
| B1961434.V1.3_s_at | GTAAATGTGCCAAGACCTAGTCCTG | SEQ ID NO: 140 |
| B1961434.V1.3_s_at | AAGACCTAGTCCTGCTACTGACACT | SEQ ID NO: 141 |
| B1961434.V1.3_s_at | TGCTACTGACACTTTCCTCGCCTTG | SEQ ID NO: 142 |
| B1961434.V1.3_s_at | CTCGCCTTGCCTATACTCTAAAGGT | SEQ ID NO: 143 |
| B1961434.V1.3_s_at | TAAAGGTTCTCAACGGATCTTTCCA | SEQ ID NO: 144 |

TABLE 2-continued

| Probe Set Name | Probe Sequence | Sequence Identifier |
|---|---|---|
| B1961434.V1.3_s_at | GATCTTTCCACCTCTGGGCTTATCA | SEQ ID NO: 145 |
| B1961434.V1.3_s_at | GGGCTTATCAGAGTTCTCAGATCTC | SEQ ID NO: 146 |
| B1961434.V1.3_s_at | GCAATAATACAATCTGCTTTTTTAA | SEQ ID NO: 147 |
| B1961438.V1.3_at | GTGGGCAGAGACTTGGCATCATTGT | SEQ ID NO: 148 |
| B1961438.V1.3_at | GGCATCATTGTCATCCAGCAAATAA | SEQ ID NO: 149 |
| B1961438.V1.3_at | TCAGTCTCCCCTAGTCCAGAAAAGG | SEQ ID NO: 150 |
| B1961438.V1.3_at | CAGAAAAGGGCCTCACCTGCCAGGG | SEQ ID NO: 151 |
| B1961438.V1.3_at | TGCGCATTGCTTTCCAAGGAGCCTT | SEQ ID NO: 152 |
| B1961438.V1.3_at | AAGGAGCCTTCTTGAGGTCACTGCA | SEQ ID NO: 153 |
| B1961438.V1.3_at | GAGGTCACTGCATTTGATCTTCATG | SEQ ID NO: 154 |
| B1961438.V1.3_at | TTTGATCTTCATGGCGGCACCTGGA | SEQ ID NO: 155 |
| B1961438.V1.3_at | GACATGAGCGTTTGTGTTTGCTTTA | SEQ ID NO: 156 |
| B1961438.V1.3_at | ATCCAGGGTGGAGTCTATGCAGAAA | SEQ ID NO: 157 |
| B1961438.V1.3_at | GAAATGACCCATAATCCAGCAACGC | SEQ ID NO: 158 |
| B1961469.V1.3_at | GGGCTAGAAGATCATCCTTGGTTGA | SEQ ID NO: 159 |
| B1961469.V1.3_at | AATTCAACATGCTCACTATCAGTAG | SEQ ID NO: 160 |
| B1961469.V1.3_at | TGAACTGAGCTTTGTCTCTGCAGCA | SEQ ID NO: 161 |
| B1961469.V1.3_at | AATGGCAGTCATCCATTGGCTGCAC | SEQ ID NO: 162 |
| B1961469.V1.3_at | TCCTCACCCTTCTTTATGTGCTTAG | SEQ ID NO: 163 |
| B1961469.V1.3_at | ATGTGCTTAGATACGTGCTCCAGAC | SEQ ID NO: 164 |
| B1961469.V1.3_at | AAGTCCCATTCATGAGCTTCCTGTT | SEQ ID NO: 165 |
| B1961469.V1.3_at | GCTTCCTGTTAGATGTGAACCTCCA | SEQ ID NO: 166 |
| B1961469.V1.3_at | GTGAACCTCCAGCAGAGGCAACGCT | SEQ ID NO: 167 |
| B1961469.V1.3_at | TGCCCCTTGGCTGGATTCATTCAAA | SEQ ID NO: 168 |
| B1961469.V1.3_at | GCAATGGTCCTCAATTCTGTTTATT | SEQ ID NO: 169 |
| B1961481.V1.3_at | ACTGACAGTTGAAACGATCAATGGA | SEQ ID NO: 170 |
| B1961481.V1.3_at | TCAATGGAATGATCAGCACAAACAG | SEQ ID NO: 171 |
| B1961481.V1.3_at | TGTGATATCCTCTATATCTAAGATA | SEQ ID NO: 172 |
| B1961481.V1.3_at | ATAACATGTACTCTCTCTATATATA | SEQ ID NO: 173 |
| B1961481.V1.3_at | GCTGTTACTGGAAAGATGACCGCAA | SEQ ID NO: 174 |
| B1961481.V1.3_at | GATGACCGCAAGAAGTTGATTTTTT | SEQ ID NO: 175 |
| B1961481.V1.3_at | GAAGTTGATTTTTTATCTACCAGAA | SEQ ID NO: 176 |
| B1961481.V1.3_at | ATCTACCAGAAGTTTTCTTCGCTGT | SEQ ID NO: 177 |
| B1961481.V1.3_at | TTTCTTCGCTGTGTTTTAAGTCGGC | SEQ ID NO: 178 |
| B1961481.V1.3_at | TTTAAGTCGGCGATCTGCTTTGATC | SEQ ID NO: 179 |
| B1961481.V1.3_at | TGCTTTGATCGTTTTGTTCGCTTCT | SEQ ID NO: 180 |
| B1961499.V1.3_at | GTCTAGTCTTGAAGTCCCTCATTTA | SEQ ID NO: 181 |
| B1961499.V1.3_at | TAATGTGATGTTTCGGCCAAGCCCA | SEQ ID NO: 182 |

TABLE 2-continued

| Probe Set Name | Probe Sequence | Sequence Identifier |
|---|---|---|
| B1961499.V1.3_at | GAGTTCCCTGCCCTGAGAGAATGTC | SEQ ID NO: 183 |
| B1961499.V1.3_at | GAGAGAATGTCACCACCTGAGCAGC | SEQ ID NO: 184 |
| B1961499.V1.3_at | AAGAGTGATGCCCTGGTGTCTCCAG | SEQ ID NO: 185 |
| B1961499.V1.3_at | GGTGATAGGACATCTGGCTTGCCAG | SEQ ID NO: 186 |
| B1961499.V1.3_at | GGCTTGCCAGCGAGGTCTTTTTGAC | SEQ ID NO: 187 |
| B1961499.V1.3_at | AGGCCACCCTTCTAGCAGAGTTAAA | SEQ ID NO: 188 |
| B1961499.V1.3_at | TATGTGTCAGTCACGTAGCCAGCTG | SEQ ID NO: 189 |
| B1961499.V1.3_at | AGAACTTGCGGCTTGACTAGCAGCA | SEQ ID NO: 190 |
| B1961499.V1.3_at | CAGCTGCCCAATGCCATGTGAAGTA | SEQ ID NO: 191 |
| B1961550.V1.3_at | AGCTCGTGCCGTTCTGTGAGACTTG | SEQ ID NO: 192 |
| B1961550.V1.3_at | GAGACTTGTCTTTCCCACGAAATAG | SEQ ID NO: 193 |
| B1961550.V1.3_at | AGACAACTCTTCCACGGCACAGATG | SEQ ID NO: 194 |
| B1961550.V1.3_at | AGACACAGTGCCGTACATCAATCAG | SEQ ID NO: 195 |
| B1961550.V1.3_at | TCAGCACGGCTTTAATCGCAGTTAT | SEQ ID NO: 196 |
| B1961550.V1.3_at | GAACGTATTTCGCTGTTGATGCCAG | SEQ ID NO: 197 |
| B1961550.V1.3_at | GATGCCAGTTATTCTGCTAACGATG | SEQ ID NO: 198 |
| B1961550.V1.3_at | GTGCGAGTACTTACAGGAGTCTACA | SEQ ID NO: 199 |
| B1961550.V1.3_at | GAGTCTACACAGTTGGACACGCAGC | SEQ ID NO: 200 |
| B1961550.V1.3_at | TACGGATCTGTTTGACTCTGTCACA | SEQ ID NO: 201 |
| B1961550.V1.3_at | GATACACGGCATCCAAAGCTATTTG | SEQ ID NO: 202 |
| B1961567.V1.3_at | GGACCGCGTCTGGAGGATGCCTCTC | SEQ ID NO: 203 |
| B1961567.V1.3_at | TGCCTCTCTTTGACCATTATACTAG | SEQ ID NO: 204 |
| B1961567.V1.3_at | TTGTCGATTGCCAACTTGCTGATGT | SEQ ID NO: 205 |
| B1961567.V1.3_at | GAGCATGTACAGCTGCAGCATTCCT | SEQ ID NO: 206 |
| B1961567.V1.3_at | TGTGACTCATCCTAAGTGGGCGCAT | SEQ ID NO: 207 |
| B1961567.V1.3_at | TGGGCGCATTTAGACATAGCAGGAG | SEQ ID NO: 208 |
| B1961567.V1.3_at | GAGATTCCGTATCTGCGTAAAGGCA | SEQ ID NO: 209 |
| B1961567.V1.3_at | ACGAGGACCCTGATAGAGTTCTTGC | SEQ ID NO: 210 |
| B1961567.V1.3_at | AGAGTTCTTGCTTCGGTTCAGTCAA | SEQ ID NO: 211 |
| B1961567.V1.3_at | AAATGCCTTCATTCTGTCTTAAGTG | SEQ ID NO: 212 |
| B1961567.V1.3_at | AAAACTAATGGCTTGCTTGGCAAAG | SEQ ID NO: 213 |
| B1961581.V1.3_at | TACTGTCACCTATCAAGCGTCTTAA | SEQ ID NO: 214 |
| B1961581.V1.3_at | ACGGGCATCTGCTTTTGAGTGACTT | SEQ ID NO: 215 |
| B1961581.V1.3_at | GTTGCATTCTCATCTGCTAAATTGG | SEQ ID NO: 216 |
| B1961581.V1.3_at | GCTGAAAGAGATGAGTGCCCACCCT | SEQ ID NO: 217 |
| B1961581.V1.3_at | TGGACTCGCTTCAGCAGTGACGGGC | SEQ ID NO: 218 |
| B1961581.V1.3_at | TTGGAGGTCGCGTGCTTCAGTCTCG | SEQ ID NO: 219 |
| B1961581.V1.3_at | GTCTCGCGCTGATAGATGGTGTCCA | SEQ ID NO: 220 |
| B1961581.V1.3_at | TCCCGCCAGCTGAGAGTGAGCCAAA | SEQ ID NO: 221 |

TABLE 2-continued

| Probe Set Name | Probe Sequence | Sequence Identifier |
|---|---|---|
| B1961581.V1.3_at | AAACTCCCAGCTTTCGGTCCAGAAG | SEQ ID NO: 222 |
| B1961581.V1.3_at | GAATTCAGATCACTCACTCGGGAAA | SEQ ID NO: 223 |
| B1961581.V1.3_at | GTGTCAAGCAAGTCCTCAAACGGCA | SEQ ID NO: 224 |
| B1961659.V1.3_at | CTACCCAGGGACTTTCTGACAGTAT | SEQ ID NO: 225 |
| B1961659.V1.3_at | TGAGTTTCTAAGTCAGCTTCCAGCT | SEQ ID NO: 226 |
| B1961659.V1.3_at | TTCCAGCTGTGTTTCATCTCCTTCA | SEQ ID NO: 227 |
| B1961659.V1.3_at | ATCTCCTTCACCTGCATTTTATTTG | SEQ ID NO: 228 |
| B1961659.V1.3_at | AAGCATGGTTTGTTCACTCCTTCAA | SEQ ID NO: 229 |
| B1961659.V1.3_at | TTTCCTCCACTAAGCAGATGATCCT | SEQ ID NO: 230 |
| B1961659.V1.3_at | TGGATTCCCGCTGGAGCAGTGCTAC | SEQ ID NO: 231 |
| B1961659.V1.3_at | CCTCTGTTCCGGTGATTGGTTTGTT | SEQ ID NO: 232 |
| B1961659.V1.3_at | GATTGGTTTGTTCCTTTCTTGTATC | SEQ ID NO: 233 |
| B1961659.V1.3_at | ACAACTACACGATCCCAGAGACATA | SEQ ID NO: 234 |
| B1961659.V1.3_at | GTTAATTCCAGCTGACGAGAGACCA | SEQ ID NO: 235 |
| B1961690.V1.3_at | AGCATCAAGGCCTATGTCAGCACTT | SEQ ID NO: 236 |
| B1961690.V1.3_at | GTGATGTTCACACCTCTGACAGTGA | SEQ ID NO: 237 |
| B1961690.V1.3_at | AACGCATCGGAGTTGACCTGATCAT | SEQ ID NO: 238 |
| B1961690.V1.3_at | TCATGAAGACCTGTTTTAGCCCCAA | SEQ ID NO: 239 |
| B1961690.V1.3_at | GGGTGATCGGACTCTCAAGTGACTT | SEQ ID NO: 240 |
| B1961690.V1.3_at | CTGACAATACAGTGGGCCGCTTCTT | SEQ ID NO: 241 |
| B1961690.V1.3_at | GCCGCTTCTTGATGAGTCTGGTTAA | SEQ ID NO: 242 |
| B1961690.V1.3_at | GTTCCTGATGACTTCGAGACCATGC | SEQ ID NO: 243 |
| B1961690.V1.3_at | TGATGGTGACCTACTTGGCCAATCT | SEQ ID NO: 244 |
| B1961690.V1.3_at | TGGCCAATCTCACACAATCACAAAT | SEQ ID NO: 245 |
| B1961690.V1.3_at | GTAAACCTGTGAATGGGCCCCAATC | SEQ ID NO: 246 |
| B1961693.V1.3_at | TACTTTTCACATGGGCCCCTCTATG | SEQ ID NO: 247 |
| B1961693.V1.3_at | CCTCTATGTGACCTGCTTAGGGTAA | SEQ ID NO: 248 |
| B1961693.V1.3_at | GACCTCCTTAGGGTAAGTATCACCA | SEQ ID NO: 249 |
| B1961693.V1.3_at | GTATCACCAGGGATTTATGTATTTA | SEQ ID NO: 250 |
| B1961693.V1.3_at | AATAGTTTTCTTGAGCAGCTGCTGG | SEQ ID NO: 251 |
| B1961693.V1.3_at | TCTTGAGCAGCTGCTGGGATCTGCT | SEQ ID NO: 252 |
| B1961693.V1.3_at | GAAGCTTTGCTAATAATCCATTTAT | SEQ ID NO: 253 |
| B1961693.V1.3_at | AATCCATTTATATGGGCTGAATTAT | SEQ ID NO: 254 |
| B1961693.V1.3_at | GCTATAAATTGATCAAGGCCACTTT | SEQ ID NO: 255 |
| B1961693.V1.3_at | AAGGCCACTTTATTATGGAATCCCA | SEQ ID NO: 256 |
| B1961693.V1.3_at | ATTATGGAATCCCATCTGCTACCCT | SEQ ID NO: 257 |
| B1961697.V1.3_at | AAACTTATGTCCTCAGTTCCATCTG | SEQ ID NO: 258 |
| B1961697.V1.3_at | AACCCAATGGCACCTTCAGCAGTAA | SEQ ID NO: 259 |

TABLE 2-continued

| Probe Set Name | Probe Sequence | Sequence Identifier |
|---|---|---|
| B1961697.V1.3_at | GAATTTTACCCCATCATATACCTGA | SEQ ID NO: 260 |
| B1961697.V1.3_at | ATATGTTTTCCTGCAGCCTTATAAG | SEQ ID NO: 261 |
| B1961697.V1.3_at | GTTTTCATGCTAAACCTGGCCATTT | SEQ ID NO: 262 |
| B1961697.V1.3_at | GGCCATTTCAGATCTCTTGTTCACA | SEQ ID NO: 263 |
| B1961697.V1.3_at | GTCTTATTCCCTATATGTCAACATG | SEQ ID NO: 264 |
| B1961697.V1.3_at | CATCTATTTCCTGACTGTGCTGAGT | SEQ ID NO: 265 |
| B1961697.V1.3_at | TTGTGCGTTTCCTGGCAACTGTTCA | SEQ ID NO: 266 |
| B1961697.V1.3_at | AAGTGCCTGGATTCTATGTGGGATC | SEQ ID NO: 267 |
| B1961697.V1.3_at | GGATCTTTATTATGGCTTCGTCAGC | SEQ ID NO: 268 |
| B1961698.V1.3_at | TTCAAATTTAGCTGGAAATCCTGTA | SEQ ID NO: 269 |
| B1961698.V1.3_at | AAATCCTGTATTTTGCTGTTGTTGC | SEQ ID NO: 270 |
| B1961698.V1.3_at | TTTTGCTGTTGTTGCTAAATCTTGC | SEQ ID NO: 271 |
| B1961698.V1.3_at | TAAATCTTGCAACCCTAGTCTGCTG | SEQ ID NO: 272 |
| B1961698.V1.3_at | TAGTCTGCTGCCCAGGATCCATGAG | SEQ ID NO: 273 |
| B1961698.V1.3_at | ATCCATGAGTCCCTGTTCAACTAAG | SEQ ID NO: 274 |
| B1961698.V1.3_at | GTTCAACTAAGCCTTGGTTTCTTCT | SEQ ID NO: 275 |
| B1961698.V1.3_at | TGGTTTCTTCTTTAATCCTAAACTG | SEQ ID NO: 276 |
| B1961698.V1.3_at | GGAGAAAAGCATCAGCCACTATCCT | SEQ ID NO: 277 |
| B1961698.V1.3_at | ACTATCCTCCCTCACAGAGAGCTGA | SEQ ID NO: 278 |
| B1961698.V1.3_at | GGACTGGTGGAAGCACATTAACTTA | SEQ ID NO: 279 |
| B1961707.V1.3_at | TGTTCTTATCAGTCATGGGCCATCC | SEQ ID NO: 280 |
| B1961707.V1.3_at | TGGGCCATCCGCAGGGTAGCAAGAT | SEQ ID NO: 281 |
| B1961707.V1.3_at | AGTCATTCTACTTTTAGCACGTGTC | SEQ ID NO: 282 |
| B1961707.V1.3_at | AGCACGTGTCCATGGGCTACAATTG | SEQ ID NO: 283 |
| B1961707.V1.3_at | ATTGGTTGGCTTGACCAAGGTCTGC | SEQ ID NO: 284 |
| B1961707.V1.3_at | CAAGGTCTGCATGTGGAATGTCCGT | SEQ ID NO: 285 |
| B1961707.V1.3_at | GGAATGTCCGTGATCTCTTAACTAC | SEQ ID NO: 286 |
| B1961707.V1.3_at | TAGACAGGGCCAAGACTAGCACAAG | SEQ ID NO: 287 |
| B1961707.V1.3_at | GGATGCCCTCATTTTGAAGTCGTGC | SEQ ID NO: 288 |
| B1961707.V1.3_at | GAGTGTCTTCTTAAATTCTTTGCCT | SEQ ID NO: 289 |
| B1961707.V1.3_at | TAAATTCTTTGCCTCACTCTAGTGC | SEQ ID NO: 290 |
| B1961708.V1.3_at | CGAGCCTTCTTTGGGTCCCAGAATA | SEQ ID NO: 291 |
| B1961708.V1.3_at | AATAACTTCTGTGCCTTCAATCTGA | SEQ ID NO: 292 |
| B1961708.V1.3_at | AACACTACCTCAGCTGGTCAATGCT | SEQ ID NO: 293 |
| B1961708.V1.3_at | GTCAATGCTCCTGGGTGTGGGCACC | SEQ ID NO: 294 |
| B1961708.V1.3_at | ACTAGTCCTAGGCATCATGGCGGTG | SEQ ID NO: 295 |
| B1961708.V1.3_at | ATGCTGCTGGCAGGAGGCCTGTTTA | SEQ ID NO: 296 |
| B1961708.V1.3_at | GCCTGTTTATGCTGCTGGGCCACAA | SEQ ID NO: 297 |
| B1961708.V1.3_at | GGGCCACAAGCGGTACTCAGAATAC | SEQ ID NO: 298 |

TABLE 2-continued

| Probe Set Name | Probe Sequence | Sequence Identifier |
|---|---|---|
| B1961708.V1.3_at | AATTGAGACCCACTCTCTAGAGGGA | SEQ ID NO: 299 |
| B1961708.V1.3_at | GAAGGACATTACTGGACCTGCCTTG | SEQ ID NO: 300 |
| B1961708.V1.3_at | GCTCCCTTCTTGCTTTTATGCAGAA | SEQ ID NO: 301 |
| B1961711.V1.3_at | CCGTTCGCGTGCACCCAGGGAGGAC | SEQ ID NO: 302 |
| B1961711.V1.3_at | TGCACCCAGGGAGGACTCGGAGTCC | SEQ ID NO: 303 |
| B1961711.V1.3_at | CATTTTCTTCTGGTCGCCGTGGTCA | SEQ ID NO: 304 |
| B1961711.V1.3_at | GTCGCCGTGGTCACCCACAGGAAGG | SEQ ID NO: 305 |
| B1961711.V1.3_at | CAGCCTGGGTTTTCTCGGGCGGCTC | SEQ ID NO: 306 |
| B1961711.V1.3_at | CAGGTCTCAGCCTGTGAGGACTGCG | SEQ ID NO: 307 |
| B1961711.V1.3_at | GACTGCGGCGAGTCTGGAGACCCCA | SEQ ID NO: 308 |
| B1961711.V1.3_at | TCTTCGGGACTGTGTGGACCCACGA | SEQ ID NO: 309 |
| B1961711.V1.3_at | GTGTGGACCCACGAGGGCCATCTGC | SEQ ID NO: 310 |
| B1961711.V1.3_at | GAGGGCCATCTGCTGACAGAGCAAC | SEQ ID NO: 311 |
| B1961711.V1.3_at | GTGGGCTCTGTCTGGTTCACAGAGC | SEQ ID NO: 312 |
| B1961718.V1.3_at | AGGAGGTGCCTCACGACTGTCCTGG | SEQ ID NO: 313 |
| B1961718.V1.3_at | GAGGGACCTCATGCCAAGGGTGCCC | SEQ ID NO: 314 |
| B1961718.V1.3_at | GCCTGACCCGGCCATAGAGGAAATC | SEQ ID NO: 315 |
| B1961718.V1.3_at | CAAGATCTTGGTGTTGTCTGGGAAA | SEQ ID NO: 316 |
| B1961718.V1.3_at | TGGGAAAAGCACGTTCAGCGCCCAC | SEQ ID NO: 317 |
| B1961718.V1.3_at | ATGAAAACACGCAGCTCGTTGGCTC | SEQ ID NO: 318 |
| B1961718.V1.3_at | TTGGCTCCTGAGACCCCGGAGGACA | SEQ ID NO: 319 |
| B1961718.V1.3_at | CAGCGAGGAGGCACAGCACACGGTC | SEQ ID NO: 320 |
| B1961718.V1.3_at | AGCCTGACCCGCTGGGCGACAGAGT | SEQ ID NO: 321 |
| B1961718.V1.3_at | GTCACAGTTCCAGAGACACTTGAGT | SEQ ID NO: 322 |
| B1961718.V1.3_at | AGATTTGTACACTTCTCTCGTAGAA | SEQ ID NO: 323 |
| B1961720.V1.3_at | AGCCTCAATCTGCTGTTAGTCCTAA | SEQ ID NO: 324 |
| B1961720.V1.3_at | AATGGGCTAGCAAAGGCCATCTTCT | SEQ ID NO: 325 |
| B1961720.V1.3_at | GCCATCTTCTCACTACTTGGATAGA | SEQ ID NO: 326 |
| B1961720.V1.3_at | AAACTCCTGTACCTTGTTTGCAGTG | SEQ ID NO: 327 |
| B1961720.V1.3_at | GTGGCAAATACATTTCCCAGCAGGC | SEQ ID NO: 328 |
| B1961720.V1.3_at | TTCCCAGCAGGCCTTTATTGATTGT | SEQ ID NO: 329 |
| B1961720.V1.3_at | TTGTACTAACCTCAAAGCTGCTGGA | SEQ ID NO: 330 |
| B1961720.V1.3_at | GTCCATTTGGTTGATGAGCTCTGCC | SEQ ID NO: 331 |
| B1961720.V1.3_at | GAGCTCTGCCATTTTGGAACCTAAT | SEQ ID NO: 332 |
| B1961720.V1.3_at | GGAACCTAATCTCTACTCTTTAGCT | SEQ ID NO: 333 |
| B1961720.V1.3_at | AGCTACATATGCCATCTACAGGTCC | SEQ ID NO: 334 |
| B1961724.V1.3_at | CACGGGAAGGTCGAAGTTTCAGACA | SEQ ID NO: 335 |
| B1961724.V1.3_at | TGAGGGCATTCAAATTGTCTTTTTT | SEQ ID NO: 336 |

TABLE 2-continued

| Probe Set Name | Probe Sequence | Sequence Identifier |
|---|---|---|
| B1961724.V1.3_at | TTTTTTCCATCCTCGTCTGTCAGTT | SEQ ID NO: 337 |
| B1961724.V1.3_at | CTCGTCTGTCAGTTTCCCTGAAAAA | SEQ ID NO: 338 |
| B1961724.V1.3_at | AAATTCATATTCCAGTGCCTATCCG | SEQ ID NO: 339 |
| B1961724.V1.3_at | AGTGCCTATCCGTGGGATCCTTCAC | SEQ ID NO: 340 |
| B1961724.V1.3_at | GATCCTTCACGTTCTTTGACATTGA | SEQ ID NO: 341 |
| B1961724.V1.3_at | AAAAAGAGAACTCACCTCGCTCTTC | SEQ ID NO: 342 |
| B1961724.V1.3_at | TGTGCCCCTCTGATACTGGCAGATG | SEQ ID NO: 343 |
| B1961724.V1.3_at | GATACTGGCAGATGCCTCTTCCTCT | SEQ ID NO: 344 |
| B1961724.V1.3_at | ACGCACGCACCCCAGTGGTGGGTTC | SEQ ID NO: 345 |
| B1961731.V1.3_at | GAGAAACTCCTAAGTTCCTGTGGAA | SEQ ID NO: 346 |
| B1961731.V1.3_at | AACCTATGGTGGCTGTGAAGGCCCT | SEQ ID NO: 347 |
| B1961731.V1.3_at | AGGCCCTGATGCCATGTATGTCAAA | SEQ ID NO: 348 |
| B1961731.V1.3_at | AATTGATATCCTCTGATGGCCATGA | SEQ ID NO: 349 |
| B1961731.V1.3_at | GAGAACACGCACTAACATCAGGAAC | SEQ ID NO: 350 |
| B1961731.V1.3_at | TGAGTGGCCCAGGTCAGTTTGCTGA | SEQ ID NO: 351 |
| B1961731.V1.3_at | TAGAGAGATCCCTTCACATGTGTTG | SEQ ID NO: 352 |
| B1961731.V1.3_at | AAGGTTCGCTACACTAACAGCTCCA | SEQ ID NO: 353 |
| B1961731.V1.3_at | AGCTCCACGGAGATTCCTGAATTCC | SEQ ID NO: 354 |
| B1961731.V1.3_at | CCTGAATTCCCAATTGCACCTGAAA | SEQ ID NO: 355 |
| B1961731.V1.3_at | ACTGGAACTGCTGATGGCTGCGAAC | SEQ ID NO: 356 |
| B1961732.V1.3_at | AGACCTGCATATTCGGTGACCTTAA | SEQ ID NO: 357 |
| B1961732.V1.3_at | GTAGAGAACACTGATTCCCAATCCC | SEQ ID NO: 358 |
| B1961732.V1.3_at | TCCCACCCAGAGATTAGTTTTCGTT | SEQ ID NO: 359 |
| B1961732.V1.3_at | GTTTTCGTTGCAACATGGAACAGTT | SEQ ID NO: 360 |
| B1961732.V1.3_at | GGAAGTTAACGATCTGCCCGGGTCT | SEQ ID NO: 361 |
| B1961732.V1.3_at | CGATCTGCCCGGGTCTAGAGGAAGA | SEQ ID NO: 362 |
| B1961732.V1.3_at | AGGAAGACCAGGAACGCCTTGCCAT | SEQ ID NO: 363 |
| B1961732.V1.3_at | TTGCCATCGGCAGAAGCGTCGTTGA | SEQ ID NO: 364 |
| B1961732.V1.3_at | TCGTTGATGCGAGCTGGATGTCCTC | SEQ ID NO: 365 |
| B1961732.V1.3_at | GGATGTCCTCCTTTTCAGTAGAAAC | SEQ ID NO: 366 |
| B1961732.V1.3_at | GTGAACTGCACATTGATCCCATTTT | SEQ ID NO: 367 |
| B1961735.V1.3_at | AAAGCTGTGCCTCCGAGCAAGCAAA | SEQ ID NO: 368 |
| B1961735.V1.3_at | AGCAAAAAGAGTTCGCCCATGGATC | SEQ ID NO: 369 |
| B1961735.V1.3_at | GAGTTCGCCCATGGATCGAAACAGT | SEQ ID NO: 370 |
| B1961735.V1.3_at | GGATCGAAACAGTGACGAGTTCCGT | SEQ ID NO: 371 |
| B1961735.V1.3_at | GACGAGTTCCGTCAACGCAGAGAGA | SEQ ID NO: 372 |
| B1961735.V1.3_at | GAGAGAGGAACATCATGGCCGTGAA | SEQ ID NO: 373 |
| B1961735.V1.3_at | TCATGGCCGTGAAAAGAGCCGGTT | SEQ ID NO: 374 |
| B1961735.V1.3_at | AAGAGCCGGTTGAAAAGCAAGCAGA | SEQ ID NO: 375 |

TABLE 2-continued

| Probe Set Name | Probe Sequence | Sequence Identifier |
|---|---|---|
| B1961735.V1.3_at | AGCAAGCAGAAAGCGCAGGATACAC | SEQ ID NO: 376 |
| B1961735.V1.3_at | TACACTGCAGAGAGTGAATCAGCTT | SEQ ID NO: 377 |
| B1961735.V1.3_at | GAAGAGAATGATCGCTTGGAAGCAA | SEQ ID NO: 378 |
| B1961737.V1.3_at | GAATGAGTAGCTTTCTGATGCTCTG | SEQ ID NO: 379 |
| B1961737.V1.3_at | TGATGCTCTGTATGTCAAACCCACC | SEQ ID NO: 380 |
| B1961737.V1.3_at | ACCCCTGGCCCAAGAAATTGCAGTC | SEQ ID NO: 381 |
| B1961737.V1.3_at | AAACTGCCCTTTGTCCTCAAAGAAG | SEQ ID NO: 382 |
| B1961737.V1.3_at | TATCTGCCTTGTTCTTATCAACTTG | SEQ ID NO: 383 |
| B1961737.V1.3_at | TCTAACCGTGTTTTGTTCCCTACAG | SEQ ID NO: 384 |
| B1961737.V1.3_at | AAGTGCCCTAATTGAATGTGTTTGA | SEQ ID NO: 385 |
| B1961737.V1.3_at | GTGTTTGAATGTTATCCTTGCACAA | SEQ ID NO: 386 |
| B1961737.V1.3_at | AAATGTTTTACCTCACTGTTGGACA | SEQ ID NO: 387 |
| B1981737.V1.3_at | ACATTCCAAGCTTTTCAACTCTAGG | SEQ ID NO: 388 |
| B1961737.V1.3_at | AGTCATATGTTTTCCTGTATTGTAA | SEQ ID NO: 389 |
| B1961738.V1.3_at | GATTTTGCCTTTGGTTTGGGTCTCA | SEQ ID NO: 390 |
| B1961738.V1.3_at | TTAATCTTTTTTCTGGCTTCTTCTG | SEQ ID NO: 391 |
| B1961738.V1.3_at | TGGCTTCTTCTGCATGTTCTAGGAA | SEQ ID NO: 392 |
| B1961738.V1.3_at | AGAGTTGTATGTATTCTTCCCGGAA | SEQ ID NO: 393 |
| B1961738.V1.3_at | TTCCCGGAATTTGGCAGACTTCTCG | SEQ ID NO: 394 |
| B1981738.V1.3_at | AAACAGCTTACTGGCGCTTTCCAAT | SEQ ID NO: 395 |
| B1961738.V1.3_at | CTCCCCTGTGGATGTGTTGATTGCA | SEQ ID NO: 396 |
| B1961738.V1.3_at | GATTTTATCTCCAACTTGTGCCTGT | SEQ ID NO: 397 |
| B1961738.V1.3_at | GGATAAGTGGCCTGCTGGACCTGCT | SEQ ID NO: 398 |
| B1961738.V1.3_at | GCTGCATGATTTCACCACTGGTCAA | SEQ ID NO: 399 |
| B1961738.V1.3_at | TAAACTGAAGCACCTTGGCCATCTG | SEQ ID NO: 400 |
| B1961739.V1.3_at | GCTGGATCCCTCACAGGGCTGGGAA | SEQ ID NO: 401 |
| B1981739.V1.3_at | GGCAATGGGAGTACACTTTGATGAC | SEQ ID NO: 402 |
| B1961739.V1.3_at | GTGATTATTTCCGTAGTGACCCTGC | SEQ ID NO: 403 |
| B1961739.V1.3_at | AGTGACCCTGCCTGGGAGGCTCAGA | SEQ ID NO: 404 |
| B1961739.V1.3_at | GCAGGCAGGGATCAGACGTCATTAT | SEQ ID NO: 405 |
| B1981739.V1.3_at | ATGAACACAGTGATGGGCGGCAGTC | SEQ ID NO: 406 |
| B1961739.V1.3_at | TCGCCCCATGAGTGTCCCTTTGAGG | SEQ ID NO: 407 |
| B1961739.V1.3_at | AAGAGGGATGCTGCATTTCTCAGCT | SEQ ID NO: 408 |
| B1961739.V1.3_at | GCATTTCTCAGCTGGGCAGTAATCA | SEQ ID NO: 409 |
| B1961739.V1.3_at | GCAGTAATCAACTTAATGGTCCTTT | SEQ ID NO: 410 |
| B1961739.V1.3_at | ATGGTCCTTTTAAAATGTCTGTGTA | SEQ ID NO: 411 |
| B1961740.V1.3_at | GTTATCATGGCCACAAACCGAATAG | SEQ ID NO: 412 |
| B1961740.V1.3_at | TTGGACCCAGCACTTATCAGACCAG | SEQ ID NO: 413 |

TABLE 2-continued

| Probe Set Name | Probe Sequence | Sequence Identifier |
|---|---|---|
| B1961740.V1.3_at | AGACCAGGCCGCATTGACAGGAAGA | SEQ ID NO: 414 |
| B1961740.V1.3_at | CCCCTGCCTGATGAGAAGACCAAGA | SEQ ID NO: 415 |
| B1961740.V1.3_at | AGAAGCGCATCTTTCAGATCCACAC | SEQ ID NO: 416 |
| B1961740.V1.3_at | AGATCCACACCAGCAGGATGACGCT | SEQ ID NO: 417 |
| B1961740.V1.3_at | GATGACGCTGGCTGACGACGTTACC | SEQ ID NO: 418 |
| B1961740.V1.3_at | GTTACCCTGGACGACTTGATCATGG | SEQ ID NO: 419 |
| B1961740.V1.3_at | ATGGCTAAAGACGACCTGTCCGGTG | SEQ ID NO: 420 |
| B1961740.V1.3_at | TGTCCGGTGCCGACATCAAGGCAAT | SEQ ID NO: 421 |
| B1961740.V1.3_at | AGAAGCTGGTCTGATGGCCTTGAGA | SEQ ID NO: 422 |
| B1961742.V1.3_at | CTTTGAGTTGATGCGGGAGCCATGC | SEQ ID NO: 423 |
| B1961742.V1.3_at | CGGCATCACTTATGACCGCAAAGAC | SEQ ID NO: 424 |
| B1961742.V1.3_at | ACCGCAAAGACATCGAGGAGCACCT | SEQ ID NO: 425 |
| B1961742.V1.3_at | AGGAGCACCTGCAGCGTGTAGGCCA | SEQ ID NO: 426 |
| B1961742.V1.3_at | GTGTAGGCCACTTTGACCCTGTGAC | SEQ ID NO: 427 |
| B1961742.V1.3_at | CATCCCTAACCTGGCCATGAAAGAG | SEQ ID NO: 428 |
| B1961742.V1.3_at | AAGAGGTCATCGACGCATTCATCTC | SEQ ID NO: 429 |
| B1961742.V1.3_at | ATTCATCTCCGAGAACGGCTGGGTG | SEQ ID NO: 430 |
| B1961742.V1.3_at | TGCCTGGTAACCTGGCCCTAGAGGG | SEQ ID NO: 431 |
| B1961742.V1.3_at | GTACAGAGTTTGTGTCCCTGGATCC | SEQ ID NO: 432 |
| B1961742.V1.3_at | ATCAGTTCTGCTGCTGGGCCGTGAG | SEQ ID NO: 433 |
| B1961743.V1.3_at | AATGGGCTCCGTCATGATCTTATGT | SEQ ID NO: 434 |
| B1961743.V1.3_at | TTCCTTCAAATCTGAGGCTTGCCTG | SEQ ID NO: 435 |
| B1961743.V1.3_at | GCAGAGCGCCTGTGATTTGGCTCAA | SEQ ID NO: 436 |
| B1961743.V1.3_at | GATTTGGCTCAAGACTCCTGTATGA | SEQ ID NO: 437 |
| B1961743.V1.3_at | GAAAATGCTGCTCTTCTAAGTCCTT | SEQ ID NO: 438 |
| B1961743.V1.3_at | CTAAGTCCTTTGTGGCTTGTAAGTG | SEQ ID NO: 439 |
| B1961743.V1.3_at | GAATTTCATCCAAATGTTACCCTGT | SEQ ID NO: 440 |
| B1961743.V1.3_at | TGTTACCCTGTAATACTGGCATTTA | SEQ ID NO: 441 |
| B1961743.V1.3_at | TCTTCCTCACCCTTTTTACAGTGGA | SEQ ID NO: 442 |
| B1961743.V1.3_at | TAATAATTGGAACATCCTGCCCCTT | SEQ ID NO: 443 |
| B1961743.V1.3_at | CAATCCTAGTTGTCTACCTTCTTTT | SEQ ID NO: 444 |
| B1961745.V1.3_at | GATAGACTGAGTCCACGTCTCCTTA | SEQ ID NO: 445 |
| B1961745.V1.3_at | AGGTCTATATATAAGGTGGCCCCAC | SEQ ID NO: 446 |
| B1961745.V1.3_at | ACATTGCCTGCTAACTTGACTTCTT | SEQ ID NO: 447 |
| B1961745.V1.3_at | GCTCGGCTTATGTCAGTATTCTCTG | SEQ ID NO: 448 |
| B1961745.V1.3_at | TTTGCCTTCATGTGCCAAGCTTGAA | SEQ ID NO: 449 |
| B1961745.V1.3_at | GATTTGATTTCCTGAGTGACCTGTC | SEQ ID NO: 450 |
| B1961745.V1.3_at | TGACCTGTCTGCTTTCGATGTGCCA | SEQ ID NO: 451 |
| B1961745.V1.3_at | TAGTTCATCTTTCATCTCATTCGTG | SEQ ID NO: 452 |

TABLE 2-continued

| Probe Set Name | Probe Sequence | Sequence Identifier |
|---|---|---|
| B1961745.V1.3_at | GGGTCAAGTCTTTTCAGGTGTTTAT | SEQ ID NO: 453 |
| B1961745.V1.3_at | AAATGATTTTGTGTTCCCTTCCCAT | SEQ ID NO: 454 |
| B1961745.V1.3_at | AAGCCCAGTGTATTGTACTTCACCC | SEQ ID NO: 455 |
| B1961746.V1.3_at | TGTGCAGTCCCACATGCTCATGGTG | SEQ ID NO: 456 |
| B1961746.V1.3_at | TCCAGGAGGCCTGTCATGTCCAGCA | SEQ ID NO: 457 |
| B1961746.V1.3_at | AGTGGGCACACTCCTGAAGCAGCTG | SEQ ID NO: 458 |
| B1961746.V1.3_at | GGAAGGGCCACGTGTGCACCAGCTC | SEQ ID NO: 459 |
| B1961746.V1.3_at | ACGACGGTCTTCTTGTCCATGAAGG | SEQ ID NO: 460 |
| B1961746.V1.3_at | TGAAGGCCACCTTGAACAGCAGAGG | SEQ ID NO: 461 |
| B1961746.V1.3_at | TGCCGCGTGCTCAGGAACACAAGCG | SEQ ID NO: 462 |
| B1961746.V1.3_at | AGGAAGCCACCTCGCTGTAACAGGA | SEQ ID NO: 463 |
| B1961746.V1.3_at | GTAACAGGACAGACCAACCGAGCAC | SEQ ID NO: 464 |
| B1961746.V1.3_at | AACCGAGCACCTGTCACGAGAGGAA | SEQ ID NO: 465 |
| B1961746.V1.3_at | AAAGCAGCCAGTGGTCACCGTGGGA | SEQ ID NO: 466 |
| B1961755.V1.3_at | ATTCTCCAAGAAATAGCCTACTCAA | SEQ ID NO: 467 |
| B1961755.V1.3_at | TAGCTGAGAACTTCCCAAACCTGGG | SEQ ID NO: 468 |
| B1961755.V1.3_at | GAAGACAACAGACCTCCGAACTATA | SEQ ID NO: 469 |
| B1961755.V1.3_at | AAAGACCTTCTCCAAGGCATATATT | SEQ ID NO: 470 |
| B1961755.V1.3_at | TAAGGGCAGCAAGGCAGAGGACAAT | SEQ ID NO: 471 |
| B1981755.V1.3_at | AAAGGGACTCCTATCAGGCTTTCAG | SEQ ID NO: 472 |
| B1961755.V1.3_at | CTTTCAGTGGATTTCTCAGCAGATA | SEQ ID NO: 473 |
| B1961755.V1.3_at | TCAGCAGATACCTTACAGGCTAGGA | SEQ ID NO: 474 |
| B1961755.V1.3_at | GAGGACAAAAACTTTCAGCCAAGAA | SEQ ID NO: 475 |
| B1961755.V1.3_at | AGCCAAGAATACTCTATCCAGTGAS | SEQ ID NO: 476 |
| B1961755.V1.3_at | GCTAAGGGAGTTTATCACCACAAGA | SEQ ID NO: 477 |
| B1961756.V1.3_at | CATTTCCACCCCAACATAGAGTAGT | SEQ ID NO: 478 |
| B1961756.V1.3_at | GAGTAGTATTTGCTTTTTAGTCCAT | SEQ ID NO: 479 |
| B1961756.V1.3_at | TGCTTTTTAGTCCATTTTGTTTTCA | SEQ ID NO: 480 |
| B1961756.V1.3_at | ATATCGATCAGAGTCATTCTTTTGT | SEQ ID NO: 481 |
| B1961758.V1.3_at | CAGAGTCATTCTTTTGTTCATTGAA | SEQ ID NO: 482 |
| B1961756.V1.3_at | CATACCCCTAAACCAACCAGGATTG | SEQ ID NO: 483 |
| B1961756.V1.3_at | AGGATTGGAAGGTACCACCGCTGGT | SEQ ID NO: 484 |
| B1961756.V1.3_at | AAGGTACCACCGCTGGTGCTGCCTT | SEQ ID NO: 485 |
| B1961756.V1.3_at | TCCCACAGCCTGTAACTTAATGTTT | SEQ ID NO: 486 |
| B1961756.V1.3_at | GTAACTTAATGTTTTGTACTTCAAT | SEQ ID NO: 487 |
| B1961756.V1.3_at | GTGATGGTTAGAAACTTCGTGTATA | SEQ ID NO: 488 |
| B1961770.V1.3_at | GTGACTATTTCACTTGACCCTTTTT | SEQ ID NO: 489 |
| B1961770.V1.3_at | TACCAAGACCCTGTGAGCTGTGTGT | SEQ ID NO: 490 |

TABLE 2-continued

| Probe Set Name | Probe Sequence | Sequence Identifier |
|---|---|---|
| B1961770.V1.3_at | GCTGTGTGTTTATTTCCCTCAATGA | SEQ ID NO: 491 |
| B1961770.V1.3_at | CCAGTCACTGCCTGTTGGAGAACAT | SEQ ID NO: 492 |
| B1961770.V1.3_at | GAACATGTCTGCATTGTGAGCCACT | SEQ ID NO: 493 |
| B1961770.V1.3_at | ATGGCATGTCAAACCACGCTTGAAT | SEQ ID NO: 494 |
| B1961770.V1.3_at | GTGTCAGGTGATAGGGCTTGTCCCC | SEQ ID NO: 495 |
| B1961770.V1.3_at | GGGCTTGTCCCCTGATAAAGCTTAG | SEQ ID NO: 496 |
| B1961770.V1.3_at | TAAAGCTTAGTATCTCCTCTCATGC | SEQ ID NO: 497 |
| B1961770.V1.3_at | CTCTCATGCCTAGTGCTTCAGAATA | SEQ ID NO: 498 |
| B1961770.V1.3_at | GTTGACAACTGTGACTGCACCCAAA | SEQ ID NO: 499 |
| B1961775.V1.3_at | TACGTCAGGTTTCAGCTACATTCGC | SEQ ID NO: 500 |
| B1961775.V1.3_at | TGATAAGCTGCTTCGATCGCAAAGA | SEQ ID NO: 501 |
| B1961775.V1.3_at | TCAGGCTCCTGAACCCACAGAAAGG | SEQ ID NO: 502 |
| B1961775.V1.3_at | AAGGGCATCTTCAGACGTAGTCACC | SEQ ID NO: 503 |
| B1961775.V1.3_at | GACAAAAACCTCATCCATGCCAATG | SEQ ID NO: 504 |
| B1961775.V1.3_at | AACATGTGGGTTCTGCAATTGGGAC | SEQ ID NO: 505 |
| B1961775.V1.3_at | ACATCAGTTACAGTGGCAGTGCCGT | SEQ ID NO: 506 |
| B1961775.V1.3_at | AGTCCTCCTCTGTGTGTTATGTAAG | SEQ ID NO: 507 |
| B1961775.V1.3_at | CTCTCCAGATTTGCAGGCTCATTAT | SEQ ID NO: 508 |
| B1961775.V1.3_at | TCATTATGAACGTGTGGCCCCAGAC | SEQ ID NO: 509 |
| B1961775.V1.3_at | GGCCCCAGACTGATGCTTGAGCTAA | SEQ ID NO: 510 |
| B1961778.V1.3_at | AGCGGCACGAGTTAGCTCAGGACAA | SEQ ID NO: 511 |
| B1961778.V1.3_at | GAATTAGCTTGCTGCTTTATTCAGA | SEQ ID NO: 512 |
| B1961778.V1.3_at | GCAGGCCCTGAGATGGACAAGAGAT | SEQ ID NO: 513 |
| B1961778.V1.3_at | GGTACTGTGATCCTGTTGTGTTAAC | SEQ ID NO: 514 |
| B1961778.V1.3_at | ATACCAAGCTGAGCGGATGCCAGAG | SEQ ID NO: 515 |
| B1961778.V1.3_at | GTGGACCCAAAGCAGCTGGCTGTTT | SEQ ID NO: 516 |
| B1961778.V1.3_at | ATGTGCCTGGCTTTTTGCCTACAAA | SEQ ID NO: 517 |
| B1961778.V1.3_at | AACGATTTAAGTCAGCCCACAGGAT | SEQ ID NO: 518 |
| B1961778.V1.3_at | CACAGGATTTTTAGCTCAGCCCATG | SEQ ID NO: 519 |
| B1961778.V1.3_at | GAACTGGAGCAGCACCTACATGCCA | SEQ ID NO: 520 |
| B1961778.V1.3_at | TGAACCCTCAAGCTCAGGCTCTTAG | SEQ ID NO: 521 |
| B1961783.V1.3_at | ATTGTTGACATTTAGCTCTGCCTGC | SEQ ID NO: 522 |
| B1961783.V1.3_at | TTTTCTCTTCTTCCATGGCTAATCA | SEQ ID NO: 523 |
| B1961783.V1.3_at | AGGACCTCTCATCATCTCAAGGTGA | SEQ ID NO: 524 |
| B1961783.V1.3_at | GACTACAGTTGTGGTCACCCTTGGC | SEQ ID NO: 525 |
| B1961783.V1.3_at | TGCCTTCCCAGCTTAGATCTTTGAA | SEQ ID NO: 526 |
| B1961783.V1.3_at | ACCACCTTTGTATCCTTTTTGCTAG | SEQ ID NO: 527 |
| B1961783.V1.3_at | AATGGCATCTTTTACTCAGTCACAA | SEQ ID NO: 528 |
| B1961783.V1.3_at | AACAAACTCTTAGCCATTCCCTATT | SEQ ID NO: 529 |

TABLE 2-continued

| Probe Set Name | Probe Sequence | Sequence Identifier |
|---|---|---|
| B1961783.V1.3_at | GGCATTTAAATTCCCAGGCAGGTAC | SEQ ID NO: 530 |
| B1961783.V1.3_at | AGGTACCCTCTCTGTGGCTAGAAAT | SEQ ID NO: 531 |
| B1961783.V1.3_at | GTTCTTTACAGCCATTGTTCTTGTG | SEQ ID NO: 532 |
| B1961785.V1.3_at | AGAATTCCAGCTGCAGCGGTTCGAT | SEQ ID NO: 533 |
| B1961785.V1.3_at | GGTTCGATGCGGAAGCCGCGCCAAT | SEQ ID NO: 534 |
| B1961785.V1.3_at | GCTCGCGAAATAGGCGTCCGATTCC | SEQ ID NO: 535 |
| B1961785.V1.3_at | GATTCCTCCCGTGTGACGGGACTCA | SEQ ID NO: 536 |
| B1961785.V1.3_at | GGCCCAGGGACTTCCAGTGCAGCAC | SEQ ID NO: 537 |
| B1961785.V1.3_at | CCTTGGCCGATTCGGCATTGGTGTA | SEQ ID NO: 538 |
| B1961785.V1.3_at | CATTGGTGTAGAAGACGAGTCCCCG | SEQ ID NO: 539 |
| B1961785.V1.3_at | GGATCGAGGCCCTTCAGCAGCACCA | SEQ ID NO: 540 |
| B1961785.V1.3_at | GGGTCCGACGACAATGTGAAGTCCT | SEQ ID NO: 541 |
| B1961785.V1.3_at | TCTCTTAACCGATCGATGGCCATTT | SEQ ID NO: 542 |
| B1961785.V1.3_at | ATGGCCATTTTCTTCCCTGTGGCAG | SEQ ID NO: 543 |
| B1961786.V1.3_at | GTCCTGACCCTGTGCTGGTGAATGG | SEQ ID NO: 544 |
| B1961786.V1.3_at | GGACTACATCCTCAAGGGCAGCAAT | SEQ ID NO: 545 |
| B1961786.V1.3_at | GCAGCAATTGGAGCCAGTGCCTAGA | SEQ ID NO: 546 |
| B1961786.V1.3_at | AGTGCCTAGAGGACCACACCTGGAT | SEQ ID NO: 547 |
| B1961786.V1.3_at | AAAAGCAGACACTGTGGCCATCCCG | SEQ ID NO: 548 |
| B1961786.V1.3_at | GGGTATCCAGCTCATGGCTGTTTTA | SEQ ID NO: 549 |
| B1961786.V1.3_at | GGAGAAGACTTCACCTCAGGATCTA | SEQ ID NO: 550 |
| B1961786.V1.3_at | ACTTAGTGGGCACACGGGACCAACA | SEQ ID NO: 551 |
| B1961786.V1.3_at | ACTTCCAGTCTGTGAGTTGATCCAA | SEQ ID NO: 552 |
| B1961786.V1.3_at | CAGCTCCACAGACCGAGTGCGAGAA | SEQ ID NO: 553 |
| B1961786.V1.3_at | TGTTGCCCTGACATTGTAGCTAAAC | SEQ ID NO: 554 |
| B1961792.V1.3_at | TTCCACACCTACCTTAGACTTTAAT | SEQ ID NO: 555 |
| B1961792.V1.3_at | GAACCTCAGCCATTTTCAATTACAG | SEQ ID NO: 556 |
| B1961792.V1.3_at | AAACTTCACTCCGTGTGTAGGGACG | SEQ ID NO: 557 |
| B1961792.V1.3_at | TAGGATAGGTTGTCTGCACCTCCCA | SEQ ID NO: 558 |
| B1961792.V1.3_at | AGAATTCTTGCTCCCTTGCTGCTGT | SEQ ID NO: 559 |
| B1961792.V1.3_at | ATACTAAAGGATGGCCAGCTGCTTC | SEQ ID NO: 560 |
| B1961792.V1.3_at | GGTTTTCATTTACTGCAGCTGCTAG | SEQ ID NO: 561 |
| B1961792.V1.3_at | GGAATTGCACTCAGACGTGACATTT | SEQ ID NO: 562 |
| B1961792.V1.3_at | GTGACATTTCAGTTCATCTCTGCTA | SEQ ID NO: 563 |
| B1961792.V1.3_at | CTATGTGTCAGTTCTGTCAGCTGCA | SEQ ID NO: 564 |
| B1961792.V1.3_at | GTCAGCTGCAGGTTCTTGTATAATG | SEQ ID NO: 565 |
| B1961795.V1.3_at | TGAAGGCTAGACATGTGGCACCCAG | SEQ ID NO: 566 |
| B1961795.V1.3_at | GGCACCCAGCGATACAGTTCTTATG | SEQ ID NO: 567 |

TABLE 2-continued

| Probe Set Name | Probe Sequence | Sequence Identifier |
|---|---|---|
| B1961795.V1.3_at | CTTATGTTTAATGTGGCCTTGGTCC | SEQ ID NO: 568 |
| B1961795.V1.3_at | GTGGCCTTGGTCCTACAAAGATTAG | SEQ ID NO: 569 |
| B1961795.V1.3_at | AAAGATTAGCTACCTCTGTCCTGAA | SEQ ID NO: 570 |
| B1961795.V1.3_at | GGAGCTTGCACATAGATACTTCAGT | SEQ ID NO: 571 |
| B1961795.V1.3_at | AAATGAGATTCGATTTGGCCCTCGC | SEQ ID NO: 572 |
| B1961795.V1.3_at | CTCGCTGCTACAGAAGCCAGGCAAT | SEQ ID NO: 573 |
| B1961795.V1.3_at | GCCAGGCAATGCTCTGACTTACTGA | SEQ ID NO: 574 |
| B1961795.V1.3_at | AGTACCATGTGGCTCGGGCACGCAA | SEQ ID NO: 575 |
| B1961795.V1.3_at | GAAACTTTTGGAACAGAGGGCTCAG | SEQ ID NO: 576 |
| B1961798.V1.3_at | AGTTTACCACCCTCCAGAAGATAGT | SEQ ID NO: 577 |
| B1961798.V1.3_at | CCAGGTCAGGAACTCGGCTACAGAA | SEQ ID NO: 578 |
| B1961798.V1.3_at | ACAGAAGCCCTCTTGTGGCTGAAGA | SEQ ID NO: 579 |
| B1961798.V1.3_at | GGACATCCAGACAGCCTTGAATAAC | SEQ ID NO: 580 |
| B1961798.V1.3_at | GGGCAGCTCCATCCTATGAAGATTT | SEQ ID NO: 581 |
| B1961798.V1.3_at | ATGAAGATTTTGTGGCCGCGTTAAC | SEQ ID NO: 582 |
| B1961798.V1.3_at | AGGTGACCACCAGAAAGCAGCTTTC | SEQ ID NO: 583 |
| B1961798.V1.3_at | GATGCAGAGGGATCTCAGCCTTTAC | SEQ ID NO: 584 |
| B1961798.V1.3_at | AGCTGGCGATACTGGACACTTTATA | SEQ ID NO: 585 |
| B1961798.V1.3_at | ACACTTTATACGAGGTCCACGGACT | SEQ ID NO: 586 |
| B1961798.V1.3_at | TATGACGTCTGCAGGACAGGGCCAC | SEQ ID NO: 587 |
| B1961799.V1.3_at | AAGAAGGCCGGGTCTGTTTCTCTTG | SEQ ID NO: 588 |
| B1961799.V1.3_at | GTTTCTCTTGGTACCCTTCAGAGTA | SEQ ID NO: 589 |
| B1961799.V1.3_at | GAAGATTTCCTGTTACACGGCTCTC | SEQ ID NO: 590 |
| B1961799.V1.3_at | GGCTCTCCCTCAAATACAATTACAA | SEQ ID NO: 591 |
| B1961799.V1.3_at | GCACCTGTTGAGCATCTGTGACCAA | SEQ ID NO: 592 |
| B1961799.V1.3_at | GAATTGTCCCAGGATCCTTACTAAG | SEQ ID NO: 593 |
| B1961799.V1.3_at | AAGGGTGTTTCAGCTGATTCGCCAC | SEQ ID NO: 594 |
| B1961799.V1.3_at | TTTGGGTTCCTTGGTTTCATCGCCG | SEQ ID NO: 595 |
| B1961799.V1.3_at | CTTGGGTCCCACTGAACTTTGTGAA | SEQ ID NO: 596 |
| B1961799.V1.3_at | TTGTGAATTCCTGTGTTCGCATCTT | SEQ ID NO: 597 |
| B1961799.V1.3_at | ATCTTCTGTTCCTGGAAGGTGTCCT | SEQ ID NO: 598 |
| B1961800.V1.3_at | TGTCCTGCAGGAACCCAAGCTTGAA | SEQ ID NO: 599 |
| B1961800.V1.3_at | AAGCTTGAACCCAGCGGCTGCTACA | SEQ ID NO: 600 |
| B1961800.V1.3_at | AAGAGTCACAAACTGTCTCCATCAC | SEQ ID NO: 601 |
| B1961800.V1.3_at | GAGCTGGCCCTCAACGAGCTGGTGA | SEQ ID NO: 602 |
| B1961800.V1.3_at | GCTTCAGCCCTAAGGAGGTGTTGGT | SEQ ID NO: 603 |
| B1961800.V1.3_at | TGCTCTGGCTGCAAGGGCACGAGAA | SEQ ID NO: 604 |
| B1961800.V1.3_at | AAGCTGCCCCGCGAGAAGTACCTGG | SEQ ID NO: 605 |
| B1961800.V1.3_at | GAAGTACCTGGTCTTTAAGCCCCTG | SEQ ID NO: 606 |

TABLE 2-continued

| Probe Set Name | Probe Sequence | Sequence Identifier |
|---|---|---|
| B1961800.V1.3_at | AGACGTCTTCTCCTGCATGGTGGGC | SEQ ID NO: 607 |
| B1961800.V1.3_at | GAGCTTCACCCAGAAGTCTATCGAC | SEQ ID NO: 608 |
| B1961800.V1.3_at | ATGTCAACGTGTCCGTGGTCATGGC | SEQ ID NO: 609 |
| B1961805.V1.3_at | TGTCATACAGTGTCCAAAACCCCAG | SEQ ID NO: 610 |
| B1961805.V1.3_at | GCGACAAGAACCTCATTGACTCCAT | SEQ ID NO: 611 |
| B1961805.V1.3_at | TTGACTCCATGGACCAAGCAGCCTT | SEQ ID NO: 612 |
| B1961805.V1.3_at | GAACCCCAAATTTGAGAGGCTCCTG | SEQ ID NO: 613 |
| B1961805.V1.3_at | AAAAGTGAGGTTCCCAGACATGCCG | SEQ ID NO: 614 |
| B1961805.V1.3_at | ATTGTTGTGATTTCTGCTGCTGCCC | SEQ ID NO: 615 |
| B1961805.V1.3_at | TTATCGTCCCCAGGAGGGTCCTTGG | SEQ ID NO: 616 |
| B1961805.V1.3_at | GCCTGGCTGGGCTCTTATGGTACTT | SEQ ID NO: 617 |
| B1961805.V1.3_at | TATGGTACTTCCTCTGTGAACTGTG | SEQ ID NO: 618 |
| B1961805.V1.3_at | ACTGTGTGTGAATTTGCCTTTCCTC | SEQ ID NO: 619 |
| B1961805.V1.3_at | AAATCCTGTGTTTTGTTACTTGAAT | SEQ ID NO: 620 |
| B1961806.V1.3_at | AAAGCAGTGATACCTCCAGAGCAGT | SEQ ID NO: 621 |
| B1961806.V1.3_at | AGCAGTGAGCTCTCTCGGCACCTAA | SEQ ID NO: 622 |
| B1961806.V1.3_at | TCGGCACCTAAGCAGTGCTTTCTAT | SEQ ID NO: 623 |
| B1961806.V1.3_at | TTTCTATACTGTTCCTCACCAAAAG | SEQ ID NO: 624 |
| B1961806.V1.3_at | AAGAACCAGTGCTCCCTGGAGAAAT | SEQ ID NO: 625 |
| B1961806.V1.3_at | ATGGCTGATTCCATGTCAGGAGCTT | SEQ ID NO: 626 |
| B1961806.V1.3_at | AAAGTAAAACTGAGCCTGGGACATC | SEQ ID NO: 627 |
| B1961806.V1.3_at | GCCTGGGACATCTTGTTGGGCCAAA | SEQ ID NO: 628 |
| B1961806.V1.3_at | GAATAGTGCTCACAGACAACTTTGA | SEQ ID NO: 629 |
| B1961806.V1.3_at | TAAAAGGGCTCCCACTGGACACATT | SEQ ID NO: 630 |
| B1961806.V1.3_at | GGACACATTCAGTACAGTTTGAGCA | SEQ ID NO: 631 |
| B1961810.V1.3_at | GAAATGTTGTACCTATCTGGGCACT | SEQ ID NO: 632 |
| B1961810.V1.3_at | GTTGTACCTATCTGGGCACTACAGA | SEQ ID NO: 633 |
| B1961810.V1.3_at | GCACTACAGAAGATGCATAGGCCTT | SEQ ID NO: 634 |
| B1961810.V1.3_at | AGATGCATAGGCCTTCCAGAGCTCA | SEQ ID NO: 635 |
| B1961810.V1.3_at | AGGCCTTCCAGAGCTCACAGAGGAA | SEQ ID NO: 636 |
| B1961810.V1.3_at | AATGCTTCAAGAGGCATGGTCCTCA | SEQ ID NO: 637 |
| B1961810.V1.3_at | AGGCATGGTCCTCAGAAATTATTCT | SEQ ID NO: 638 |
| B1961810.V1.3_at | ATTATTCTGGAATGCCGTTTCACTT | SEQ ID NO: 639 |
| B1961810.V1.3_at | GGAATGCCGTTTCACTTGTATCAAC | SEQ ID NO: 640 |
| B1961810.V1.3_at | GCCGTTTCACTTGTATCAACATCAT | SEQ ID NO: 641 |
| B1961810.V1.3_at | TCAACATCATGTTCCTGGTTCAGTT | SEQ ID NO: 642 |
| B1961812.V1.3_at | GGGCCTCCAGCCTTTGCCGCAAGTG | SEQ ID NO: 643 |
| B1961812.V1.3_at | AGCCTTTGCCGCAAGTGCCTCGGTG | SEQ ID NO: 644 |

TABLE 2-continued

| Probe Set Name | Probe Sequence | Sequence Identifier |
| --- | --- | --- |
| B1961812.V1.3_at | CAAGTGCCTCGGTGCCCGCTGGGTC | SEQ ID NO: 645 |
| B1961812.V1.3_at | CCCACCGCAAGGAGGACTCAGGACA | SEQ ID NO: 646 |
| B1961812.V1.3_at | AAGGAGGACTCAGGACAGCCCTCCA | SEQ ID NO: 647 |
| B1961812.V1.3_at | ACCCACAGAGCTTTTCCTCCTGGAC | SEQ ID NO: 648 |
| B1961812.V1.3_at | GCCGCCGGAAGGAAAGAGCTTGCCC | SEQ ID NO: 649 |
| B1961812.V1.3_at | GAAGGAAAGAGCTTGCCCGCTCCTA | SEQ ID NO: 650 |
| B1961812.V1.3_at | TTGCCCGCTCCTACAGGACGTTTAT | SEQ ID NO: 651 |
| B1961812.V1.3_at | GCTCCTACAGGACGTTTATTTTTCT | SEQ ID NO: 652 |
| B1961812.V1.3_at | CAGGACGTTTATTTTTCTCTTGCCA | SEQ ID NO: 653 |
| B1961814.V1.3_s_at | GCCAGGAGACGGTCGCCCAGATCAA | SEQ ID NO: 654 |
| B1961814.V1.3_s_at | GAAAGTCAGAGGTCAGACTCCCAAG | SEQ ID NO: 655 |
| B1961814.V1.3_s_at | CAGAGGTCAGACTCCCAAGGTGGCC | SEQ ID NO: 656 |
| B1961814.V1.3_s_at | AGGGCATCGCTGCAGAAGATCAAGT | SEQ ID NO: 657 |
| B1961814.V1.3_s_at | GATCAAGTCGTGCTCTTGGCAGGCA | SEQ ID NO: 658 |
| B1961814.V1.3_s_at | GCCCCTGGAGGATGAGGCTACTCTG | SEQ ID NO: 659 |
| B1961814.V1.3_s_at | GGAGGCTCTGACCACTCTGGAAGTA | SEQ ID NO: 660 |
| B1961814.V1.3_s_at | TGACCACTCTGGAAGTAGCCGGCCG | SEQ ID NO: 661 |
| B1961814.V1.3_s_at | AGCCGGCCGCATGCTTGGAGGTAAA | SEQ ID NO: 662 |
| B1961814.V1.3_s_at | GAGGTAAAGTCCATGGCTCCCTAGC | SEQ ID NO: 663 |
| B1961814.V1.3_s_at | CCTAGCCCGTGCTGGGAAAGTCAGA | SEQ ID NO: 664 |
| B1961815.V1.3_at | GCAGATGCCAGCTTCAGTTTAGAGA | SEQ ID NO: 665 |
| B1961815.V1.3_at | GAATGAAGCTCGTGGTTCGCAGACT | SEQ ID NO: 666 |
| B1961815.V1.3_at | GTTCGCAGACTGTCTCAACAGCATT | SEQ ID NO: 667 |
| B1961815.V1.3_at | ATAACATGTTCAAGTGCGCCTAGTG | SEQ ID NO: 668 |
| B1961815.V1.3_at | GCCTAGTGTTTTGCTACCACAATC | SEQ ID NO: 669 |
| B1961815.V1.3_at | TGGAAACTCTTTCTTCATGTACAGA | SEQ ID NO: 670 |
| B1961815.V1.3_at | GAAGCCTCAAGTGACCTGTTTTTAA | SEQ ID NO: 671 |
| B1961815.V1.3_at | GTGGACAATAACTTTCCCTTCCCAG | SEQ ID NO: 672 |
| B1961815.V1.3_at | TCCCAGTGGTTCTCATCTTAACGTA | SEQ ID NO: 673 |
| B1961815.V1.3_at | TCGAATCTTATGTGACCCATCTCTT | SEQ ID NO: 674 |
| B1961815.V1.3_at | GACCCATCTCTTCTTGAATCTTTTT | SEQ ID NO: 675 |
| B1961816.V1.3_at | GGGCATGTGCCTCCATCAGACACAG | SEQ ID NO: 676 |
| B1961816.V1.3_at | ATCAGACACAGCCAAGCTCTCCTGG | SEQ ID NO: 677 |
| B1961816.V1.3_at | GCTCTGACCTACAGCTTTGTGTTGA | SEQ ID NO: 678 |
| B1961816.V1.3_at | ATAGCTTGCGGCAGGTGGCACATGC | SEQ ID NO: 679 |
| B1961816.V1.3_at | GTGGCACATGCCACGCAGACGAGGC | SEQ ID NO: 680 |
| B1961816.V1.3_at | GGAAGTGCATCAGACCAGCGGCCAT | SEQ ID NO: 681 |
| B1961816.V1.3_at | GCAAAGTTCAGTGGGCAGCGCAGCA | SEQ ID NO: 682 |
| B1961816.V1.3_at | ATGGTGCCCCTGTAGGCCTCTGGGA | SEQ ID NO: 683 |

TABLE 2-continued

| Probe Set Name | Probe Sequence | Sequence Identifier |
|---|---|---|
| B1961816.V1.3_at | CAGCAGGCAGGAGACGGCCAAGCCA | SEQ ID NO: 684 |
| B1961816.V1.3_at | TTGGCTTCGGCCTCCTTAAGAAAGG | SEQ ID NO: 685 |
| B1961816.V1.3_at | TTAAGAAAGGGAGACACTGCCCGCA | SEQ ID NO: 686 |
| B1961817.V1.3_at | ACATCTTTTGCCTTGTTCATGGTCA | SEQ ID NO: 687 |
| B1961817.V1.3_at | GGTCATCTGGATCATCTTTTACACT | SEQ ID NO: 688 |
| B1961817.V1.3_at | TACACTGCCATCCACTATGACTGAT | SEQ ID NO: 689 |
| B1961817.V1.3_at | ATGACTGATGGTGTACAGGCCCCAC | SEQ ID NO: 690 |
| B1961817.V1.3_at | GACCCTCTTACTTACAGCACAGAAA | SEQ ID NO: 691 |
| B1961817.V1.3_at | AAGACCCATGTTTCCTGGACTGAGA | SEQ ID NO: 692 |
| B1961817.V1.3_at | GATTATTCATCACCAACCATTTCTT | SEQ ID NO: 693 |
| B1961817.V1.3_at | GAAACACCTGTTTGCTGATTGGAGC | SEQ ID NO: 694 |
| B1961817.V1.3_at | GATGCACCTCTGGATCCGGATGAAA | SEQ ID NO: 695 |
| B1961817.V1.3_at | ATTAAATTGTCTTCCTCACTTCCGT | SEQ ID NO: 696 |
| B1961817.V1.3_at | TCACTTCCGTCAGGTGTACAGTTTT | SEQ ID NO: 697 |
| B1961827.V1.3_at | GGACGTGCCCAAGCAGAACTCGCAG | SEQ ID NO: 698 |
| B1961827.V1.3_at | GAGCGCTTCCAGAACCTCGACAGGA | SEQ ID NO: 699 |
| B1961827.V1.3_at | GGTCTGGACTCGCTGCACAAGAACA | SEQ ID NO: 700 |
| B1961827.V1.3_at | AGAACAGCGTCAGCCAGATCTCGGT | SEQ ID NO: 701 |
| B1961827.V1.3_at | GGGAAAGGCCAAGTGCTCGCAGTTC | SEQ ID NO: 702 |
| B1961827.V1.3_at | GCAGTTCTGCACTACGGGCATGGAC | SEQ ID NO: 703 |
| B1961827.V1.3_at | GAGCTTGGAATCAGCCTTGAAGGAC | SEQ ID NO: 704 |
| B1961827.V1.3_at | TGACCTGCCAGGATTATGTTGCCCT | SEQ ID NO: 705 |
| B1961827.V1.3_at | ACGGTCGCTTTGCTGAATGTTTCTA | SEQ ID NO: 706 |
| B1961827.V1.3_at | GTGGGAAGCTTTTCTTACCTGTTGA | SEQ ID NO: 707 |
| B1961827.V1.3_at | TGAAGGAACACGTGCCTTTTTCTTA | SEQ ID NO: 708 |
| B1961830.V1.3_at | TCCCAGCGAGAACCAACACTGAGTC | SEQ ID NO: 709 |
| B1961830.V1.3_at | GGAACCTGGCACTTTCGTCGGCAGC | SEQ ID NO: 710 |
| B1961830.V1.3_at | TTTCGTCGGCAGCTGCAGCTTCTGG | SEQ ID NO: 711 |
| B1961830.V1.3_at | TTCTGGCTGCTTTTTTGGAGGTTCT | SEQ ID NO: 712 |
| B1961830.V1.3_at | TTTGGAGGTTCTTGGCCTGGACCCA | SEQ ID NO: 713 |
| B1961830.V1.3_at | TCTTGGCCTGGACCCATGGGCTTCG | SEQ ID NO: 714 |
| B1961830.V1.3_at | CGTGCCATGCCATACTGTCACTCAG | SEQ ID NO: 715 |
| B1961830.V1.3_at | TGTCACTCAGCCACATCAGTGTTTG | SEQ ID NO: 716 |
| B1961830.V1.3_at | ACATCAGTGTTTGTCCCACCAAGGG | SEQ ID NO: 717 |
| B1961830.V1.3_at | AGTGTTTGTCCCACCAAGGGAGGTG | SEQ ID NO: 718 |
| B1961830.V1.3_at | ATGGGTCACCCACATCTGTGCTTGG | SEQ ID NO: 719 |
| B1961841.V1.3_at | AAGAAGTGCTCAGCAGCGACACTGC | SEQ ID NO: 720 |
| B1961841.V1.3_at | TAGGCTCTCTTGTGTCCGTCATGTG | SEQ ID NO: 721 |

TABLE 2-continued

| Probe Set Name | Probe Sequence | Sequence Identifier |
|---|---|---|
| B1961841.V1.3_at | GTCCGTCATGTGCTTGTGAACACTA | SEQ ID NO: 722 |
| B1961841.V1.3_at | CTAAATTGTGAGACAGCAGCCTGTG | SEQ ID NO: 723 |
| B1961841.V1.3_at | ACAAGATTTGTTCACGTCTCAACCC | SEQ ID NO: 724 |
| B1961841.V1.3_at | GTGTCTGCATTAGTATTGGCATACT | SEQ ID NO: 725 |
| B1961841.V1.3_at | TGACCTGTGTTCTCTTCCCTGATTG | SEQ ID NO: 726 |
| B1961841.V1.3_at | CCCTGATTGACTGTTCCAGCAGAGA | SEQ ID NO: 727 |
| B1961841.V1.3_at | ATGTCTTTACTTCATGCTCCACTGA | SEQ ID NO: 728 |
| B1961841.V1.3_at | GAGCTGCAGTTTCTTAGTGCCTTAT | SEQ ID NO: 729 |
| B1961841.V1.3_at | AATTCTTGCCATGAGGGATTGACGG | SEQ ID NO: 730 |
| B1961847.V1.3_at | CCGCCGAAGCGGAGTTGTGTGAACT | SEQ ID NO: 731 |
| B1961847.V1.3_at | CAGCCCCTCATTTCTTTTTGATGAA | SEQ ID NO: 732 |
| B1961847.V1.3_at | AAGATTGTCTCTGATAAGTGGCTCA | SEQ ID NO: 733 |
| B1961847.V1.3_at | ATAAGTGGCTCAGAAGCTCCCATCT | SEQ ID NO: 734 |
| B1961847.V1.3_at | AGAAGCTCCCATCTGCTGGTGCAGG | SEQ ID NO: 735 |
| B1961847.V1.3_at | GGTGCAGGGTTTTCTGAGGCTCTTC | SEQ ID NO: 736 |
| B1961847.V1.3_at | TTTCTGAGGCTCTTCTTCCTGAGCA | SEQ ID NO: 737 |
| B1961847.V1.3_at | ACTCCGTGCTTTTCGTGTGCGTACC | SEQ ID NO: 738 |
| B1961847.V1.3_at | GCCTCCACATCAAGGGACAGTTTGT | SEQ ID NO: 739 |
| B1961847.V1.3_at | CAGTTTGTTTGTGCTTGTTTTTCTA | SEQ ID NO: 740 |
| B1961847.V1.3_at | CTAATGACATAAATTCCCTGAAGAG | SEQ ID NO: 741 |
| B1961848.V1.3_at | TCAGAGAAAATGCTGCCGCAACCTC | SEQ ID NO: 742 |
| B1961848.V1.3_at | TGCTTCCAGGGCTGTACATAGTTGG | SEQ ID NO: 743 |
| B1961848.V1.3_at | ACTGCGTGGGTCAACTCAGTGTCCA | SEQ ID NO: 744 |
| B1961848.V1.3_at | TCAGTGTCCACTTCGATGCTTGTAT | SEQ ID NO: 745 |
| B1961848.V1.3_at | CTTCGATGCTTGTATGTTTGGGTTT | SEQ ID NO: 746 |
| B1961848.V1.3_at | GTTTGGGTTTCGCATCTTCATTAAA | SEQ ID NO: 747 |
| B1961848.V1.3_at | GGGCAGCTCAGATCAGCCTGGGCCA | SEQ ID NO: 748 |
| B1961848.V1.3_at | GGATGAACCCTCAGGGCAGGGCACA | SEQ ID NO: 749 |
| B1961848.V1.3_at | AGAGCTGGCCCTGCATTCGCCTGGA | SEQ ID NO: 750 |
| B1961848.V1.3_at | GACCCTGAGCCGTCCATGGAAGCAG | SEQ ID NO: 751 |
| B1961848.V1.3_at | ATGGAAGCAGGGACCTTTTCTCCCG | SEQ ID NO: 752 |
| B1961850.V1.3_at | AAGATTATACCATTCCCTTGGAATA | SEQ ID NO: 753 |
| B1961850.V1.3_at | GAATATTTTCTTCCTAATGTCAGAG | SEQ ID NO: 754 |
| B1961850.V1.3_at | ATGTCAGAGCTTTTCCTGCATTATT | SEQ ID NO: 755 |
| B1961850.V1.3_at | GCTTTCTGAGTTGGGATGCTTTGAC | SEQ ID NO: 756 |
| B1961850.V1.3_at | GTATCACCTATTTTTAAAGCTGCTT | SEQ ID NO: 757 |
| B1961850.V1.3_at | AAAGCTGCTTTGTTAGGTTCCTTAT | SEQ ID NO: 758 |
| B1961850.V1.3_at | GTTCCTTATGTTTTAACTGTCTTAG | SEQ ID NO: 759 |
| B1961850.V1.3_at | GTCTTAGTTTCCATTTCATTCTCTT | SEQ ID NO: 760 |

TABLE 2-continued

| Probe Set Name | Probe Sequence | Sequence Identifier |
|---|---|---|
| B1961850.V1.3_at | ATCAACTTCATGGTCTTGTTTTTAC | SEQ ID NO: 761 |
| B1961850.V1.3_at | GTATTGCATGTATTTAGGACCTATC | SEQ ID NO: 762 |
| B1961850.V1.3_at | AAGTGTCCTATTCACTACTTGTTAA | SEQ ID NO: 763 |
| B1961853.V1.3_at | GAAAATGTATGCCTGCGCCAAGTTT | SEQ ID NO: 764 |
| B1961853.V1.3_at | TGCTGAGCCGATCACTGTCTGCAGT | SEQ ID NO: 765 |
| B1961853.V1.3_at | GAAACGACCGGAGACACTGACAGAT | SEQ ID NO: 766 |
| B1961853.V1.3_at | GATGAGACCCTCAGCAGCTTGGCAG | SEQ ID NO: 767 |
| B1961853.V1.3_at | AAACCAGCGCCATTTCAAGGGACAT | SEQ ID NO: 768 |
| B1961853.V1.3_at | GGGACATCGACACAGCAGCCAAGTT | SEQ ID NO: 769 |
| B1961853.V1.3_at | TTGGGACTGTATTTGGGAGCCTCAT | SEQ ID NO: 770 |
| B1961853.V1.3_at | GGAGCCTCATCATTGGTTATGCCAG | SEQ ID NO: 771 |
| B1961853.V1.3_at | TTATGCCAGGAACCCTTCTCTGAAG | SEQ ID NO: 772 |
| B1961853.V1.3_at | TTTGCCTGATGGTGGCCTTTCTCAT | SEQ ID NO: 773 |
| B1961853.V1.3_at | TTCGCCATGTGAAGAAGCCGTCTCC | SEQ ID NO: 774 |
| B1961856.V1.3_at | CACGAGGGAAGAGGGTCTCCTTCCA | SEQ ID NO: 775 |
| B1961856.V1.3_at | GAACAATTTAATTTCTTGGCCGTGT | SEQ ID NO: 776 |
| B1961856.V1.3_at | GGCCGTGTTTAGTAACAGTTCCTAT | SEQ ID NO: 777 |
| B1961856.V1.3_at | ACAGTTCCTATGCATGGTTTTTAAC | SEQ ID NO: 778 |
| B1961856.V1.3_at | ACCTGATTCTGCCTCTTTAATGAAT | SEQ ID NO: 779 |
| B1961856.V1.3_at | GAAACTCAATGCCTTATGTGCTCAC | SEQ ID NO: 780 |
| B1961856.V1.3_at | TTATGTGCTCACTCAGTTTCCCTTC | SEQ ID NO: 781 |
| B1961856.V1.3_at | AGTTTCCCTTCTGCAGCTTGTTTTT | SEQ ID NO: 782 |
| B1961856.V1.3_at | GCTTGTTTTTCTCACTATCTGTAT | SEQ ID NO: 783 |
| B1961856.V1.3_at | ATGCTGGCAAAACCTCTAAGACTGT | SEQ ID NO: 784 |
| B1961856.V1.3_at | GAAAGTTGATTTGTCCTAGTGCAAA | SEQ ID NO: 785 |
| B1961864.V1.3_at | AGACAGGTGGCTCCAAGACGTCGTC | SEQ ID NO: 786 |
| B1961864.V1.3_at | GACGTCGTCGACAGTTAAGAGCACC | SEQ ID NO: 787 |
| B1961864.V1.3_at | AAGAGCACCCCGTCTGGGAAGAGGT | SEQ ID NO: 788 |
| B1961864.V1.3_at | GGTACAAGTTTGTGGCCACCGGACA | SEQ ID NO: 789 |
| B1961864.V1.3_at | GTAGACGAAGGCTCGGCACCCTAGG | SEQ ID NO: 790 |
| B1961864.V1.3_at | TGGCCTGCCGAAGAAGCTGCTTCCA | SEQ ID NO: 791 |
| B1961864.V1.3_at | TGGCTCTGCCTCTTATAAGCTCAGG | SEQ ID NO: 792 |
| B1981864.V1.3_at | TAAGCTCAGGCTGGCAGCTGGCTAA | SEQ ID NO: 793 |
| B1961864.V1.3_at | AACTCCCAAGGAAGGTGCAGCCTGT | SEQ ID NO: 794 |
| B1961864.V1.3_at | GGACCTCATGGTCAAGAGCCAGTGA | SEQ ID NO: 795 |
| B1961864.V1.3_at | TGAGCTGGATGCTTAGGCCCTACAT | SEQ ID NO: 796 |
| B1981865.V1.3_at | AGTTTCATCATCAGGGTCCGGGTGG | SEQ ID NO: 797 |
| B1961865.V1.3_at | TAGGTTGTCAGGGTTTACTGCCTTC | SEQ ID NO: 798 |

TABLE 2-continued

| Probe Set Name | Probe Sequence | Sequence Identifier |
|---|---|---|
| B1961865.V1.3_at | TTAGCTCTTTTTTCCCTGCATTCTA | SEQ ID NO: 799 |
| B1961865.V1.3_at | CCCTGCATTCTAGCAATTCGTGATT | SEQ ID NO: 800 |
| B1961865.V1.3_at | GGGAAGAAGCAAGACCTCTCCTCAG | SEQ ID NO: 801 |
| B1961865.V1.3_at | AGACTTTGTCTCTGGGTTTCATCCT | SEQ ID NO: 802 |
| B1981865.V1.3_at | CTGTCACTCTAGGAGGGTTCGTGCT | SEQ ID NO: 803 |
| B1961865.V1.3_at | GAAGAGACATTAGCTCCTTGTTCCC | SEQ ID NO: 804 |
| B1961865.V1.3_at | TTTTCCCCACGGGTTTGGTGCACAG | SEQ ID NO: 805 |
| B1981865.V1.3_at | TTCCCATGTCCGCTCAGATGAGGAT | SEQ ID NO: 806 |
| B1961865.V1.3_at | TTTTTTCTTTTCTTGCCTGACCTCA | SEQ ID NO: 807 |
| B1961872.V1.3_at | TATGCTCTGTGTATAAGGATGAATT | SEQ ID NO: 808 |
| B1961872.V1.3_at | GAGTTGTCATTTTCTCTTCACTGGA | SEQ ID NO: 889 |
| B1961872.V1.3_at | GTCATTTTCTCTTCACTGGATGTTT | SEQ ID NO: 810 |
| B1981872.V1.3_at | TCTCTTCACTGGATGTTTATTTATA | SEQ ID NO: 811 |
| B1961872.V1.3_at | AGATTTGACCTGTTCATGCGTCTGT | SEQ ID NO: 812 |
| B1961872.V1.3_at | GTTCATGCGTCTGTGGAGCAGCCCT | SEQ ID NO: 813 |
| B1961872.V1.3_at | TCCGTCTCCCGGCTATATAGTAATC | SEQ ID NO: 814 |
| B1961872.V1.3_at | GTAATCTTAGGTAGAGTGTTGCCTT | SEQ ID NO: 815 |
| B1961872.V1.3_at | TAGAGTGTTGCCTTGTGGGTTACCG | SEQ ID NO: 816 |
| B1961872.V1.3_at | TGGGTTACCGTTTGCTCTGAGACTT | SEQ ID NO: 817 |
| B1961872.V1.3_at | TCTGAGACTTCTCGGATGGACCCAC | SEQ ID NO: 818 |
| B1961873.V1.3_at | ATGTTCAGTTCTAAGGAGTCCCAGC | SEQ ID NO: 819 |
| B1961873.V1.3_at | ATGCCCAAACGTGGCCTGGAGGTGA | SEQ ID NO: 820 |
| B1961873.V1.3_at | GATTGCCAGATTCTACAAGCTGCAC | SEQ ID NO: 821 |
| B1961873.V1.3_at | AGCGCAGGTGTGAGCCCATTGCCAT | SEQ ID NO: 822 |
| B1961873.V1.3_at | CCATTGCCATGACAGTGCCTAGAAA | SEQ ID NO: 823 |
| B1961873.V1.3_at | TAGAAAGTCGGACCTGTTCCAGGAG | SEQ ID NO: 824 |
| B1961873.V1.3_at | ATTTCCCTCAAGGATGGCTACGTGC | SEQ ID NO: 825 |
| B1961873.V1.3_at | AGACAGCACCAGAGGCCAGTGGCAC | SEQ ID NO: 826 |
| B1961873.V1.3_at | GGCACTCCTAGCTCGGATGCTGTAT | SEQ ID NO: 827 |
| B1961873.V1.3_at | AGATGAGGAAGCTCCAGGCCACTGT | SEQ ID NO: 828 |
| B1961873.V1.3_at | AGGCCACTGTGCAGGAGCTACAGAA | SEQ ID NO: 829 |
| B1961877.V1.3_at | GGAGCTGCTGTTCTTCAGACAGAGA | SEQ ID NO: 830 |
| B1961877.V1.3_at | GACTCTGAGGCTGCTCCACAAGTAC | SEQ ID NO: 831 |
| B1961877.V1.3_at | ATAAGGGCGCCATCAAGTTCGTGCT | SEQ ID NO: 832 |
| B1961877.V1.3_at | AAGACACGGTGGTCGCGATCATGGC | SEQ ID NO: 833 |
| B1981877.V1.3_at | GAAGCTCAACAAAGGCATCGGCATT | SEQ ID NO: 834 |
| B1981877.V1.3_at | GCATCGGCATTGAAAACATCCACTA | SEQ ID NO: 835 |
| B1961877.V1.3_at | AATGAGCCTGCCAAGGAGTGCGCTT | SEQ ID NO: 836 |
| B1961877.V1.3_at | AAAGGAATGCGCTTGGGCTCCAGAC | SEQ ID NO: 837 |

TABLE 2-continued

| Probe Set Name | Probe Sequence | Sequence Identifier |
|---|---|---|
| B1961877.V1.3_at | AATGCGCTTGGACTCAATGTGGACT | SEQ ID NO: 838 |
| B1961877.V1.3_at | AATGTGGACTCTGCTGTATCTGTGT | SEQ ID NO: 839 |
| B1961877.V1.3_at | TGTCCGTGTCTGTGTGTGACAGCAT | SEQ ID NO: 840 |
| B1961879.V1.3_at | GAAAGGGTGCCTGTTGTCAATAAAC | SEQ ID NO: 841 |
| B1961879.V1.3_at | GAGCTATGGCGCCTCCAATGAAGGA | SEQ ID NO: 842 |
| B1961879.V1.3_at | CAATGAAGGATCTGCCCAGGTGGCT | SEQ ID NO: 843 |
| B1961879.V1.3_at | ATTTGCAGTTGCTCCAGACTGGACT | SEQ ID NO: 844 |
| B1961879.V1.3_at | TAAGCAGTCTGGTTTTGTTCCCGAG | SEQ ID NO: 845 |
| B1961879.V1.3_at | GAGTCGATGTTTGACCGGCTTCTCA | SEQ ID NO: 846 |
| B1961879.V1.3_at | TGTGGCCTCCACTGCAGGAATCAAC | SEQ ID NO: 847 |
| B1961879.V1.3_at | GAATCAACCCTCTGCTGGTGAACAG | SEQ ID NO: 848 |
| B1961879.V1.3_at | GCCTGTTTGCTGGAATGGACCTGAC | SEQ ID NO: 849 |
| B1961879.V1.3_at | TTCAGAATCTCCAGAATCTCCAGTC | SEQ ID NO: 850 |
| B1961879.V1.3_at | GGGCCTGCCCAACATGTTTGGATTG | SEQ ID NO: 851 |
| B1961880.V1.3_at | TGAGTTCGTCATCAGGGCCAAGTTC | SEQ ID NO: 852 |
| B1961880.V1.3_at | AGACCACCTTACAGCGGCGTTATGA | SEQ ID NO: 853 |
| B1961880.V1.3_at | TGCGGATACTTCCACAGGTCGGAGA | SEQ ID NO: 854 |
| B1961880.V1.3_at | GAACCGCAGCGAGGAGTTTCTCATC | SEQ ID NO: 855 |
| B1961880.V1.3_at | TTCTCATCGCCGGACAACTATTGGA | SEQ ID NO: 856 |
| B1961880.V1.3_at | GGACGAGAAGCTGTACATCACCACC | SEQ ID NO: 857 |
| B1961880.V1.3_at | GAATGCTCAGTGTTTCCCTGTTCAT | SEQ ID NO: 858 |
| B1961880.V1.3_at | TGATTGCTTGTGGACGGACCAGCTC | SEQ ID NO: 859 |
| B1961880.V1.3_at | ACAGGCTCTGACAAGGGCTTCCAGA | SEQ ID NO: 860 |
| B1961880.V1.3_at | GAATCCTGTCTCCAGCAGAAGCTGA | SEQ ID NO: 861 |
| B1961880.V1.3_at | AGCTGAAGCTTGCACAGTGTTCACC | SEQ ID NO: 862 |
| B1961882.V1.3_at | GCTTCCTGGAGCTGGCATACCGTGG | SEQ ID NO: 863 |
| B1961882.V1.3_at | AGCTGGCATACCGTGGTCTGCGCTA | SEQ ID NO: 864 |
| B1961882.V1.3_at | GAAAGAAGCCCCAGAGCCCTGGGTG | SEQ ID NO: 865 |
| B1961882.V1.3_at | GGTGCTTCCCTCCACTTTCAAGTTT | SEQ ID NO: 866 |
| B1961882.V1.3_at | TTTCAAGTTTCATTCTCCTGCCTGT | SEQ ID NO: 867 |
| B1961882.V1.3_at | CATTCTCCTGCCTGTAGCAGGGAGA | SEQ ID NO: 868 |
| B1961882.V1.3_at | GAGAAAAGCTCCTGTCTTCCTGTC | SEQ ID NO: 869 |
| B1961882.V1.3_at | TTCCTGTCCCCTGGACTGGGAGGTA | SEQ ID NO: 870 |
| B1961882.V1.3_at | AGTATTAATTCCTGTGACTGCTCCC | SEQ ID NO: 871 |
| B1961882.V1.3_at | CTGGCCCAGCTCTGTGGTGGGCACT | SEQ ID NO: 872 |
| B1961882.V1.3_at | ACTGGGAAGAGCCTCAGTGGACCCC | SEQ ID NO: 873 |
| B1961885.V1.3_at | AATGCGGTGGCATCTTTACAGATAC | SEQ ID NO: 874 |
| B1961885.V1.3_at | TTTTAAATCTCCAGGCTTCCCAAAT | SEQ ID NO: 875 |

TABLE 2-continued

| Probe Set Name | Probe Sequence | Sequence Identifier |
|---|---|---|
| B1961885.V1.3_at | TAACCAAGTCTGCTACTGGCACATC | SEQ ID NO: 876 |
| B1961885.V1.3_at | ACTCAAGTATGGTCAGCGTATTCAC | SEQ ID NO: 877 |
| B1961885.V1.3_at | GCGTATTCACCTGAGTTTTCTGGAC | SEQ ID NO: 878 |
| B1961885.V1.3_at | AGGTTGCTTGGCTGACTATGTTGAA | SEQ ID NO: 879 |
| B1961885.V1.3_at | CTAAGCGATGCTTCGGTGACCGCAG | SEQ ID NO: 880 |
| B1961885.V1.3_at | GTGACCGCAGGAGGTTTCCAAATCA | SEQ ID NO: 881 |
| B1961885.V1.3_at | TACAAGCACTACTTCTACGGGAAAT | SEQ ID NO: 882 |
| B1961885.V1.3_at | TATGGTTGTCTCTTTTGGAACCCCT | SEQ ID NO: 883 |
| B1961885.V1.3_at | GAACCCCTTTGATCTCAGTTTTGTA | SEQ ID NO: 884 |
| B1961890.V1.3_at | TGGCAATCCTCAGTACACGTACAAC | SEQ ID NO: 885 |
| B1961890.V1.3_at | GTACAACAATTGGTCTCCTCCGGTG | SEQ ID NO: 886 |
| B1961890.V1.3_at | TTTCCTGGAGAGATCGCATAGCGCT | SEQ ID NO: 887 |
| B1961890.V1.3_at | TAGCGCTAGGATGACACTTGCAAAA | SEQ ID NO: 888 |
| B1961890.V1.3_at | AAAAGCTTGTGAACTCTGTCCAGAG | SEQ ID NO: 889 |
| B1961890.V1.3_at | AGATGACCAAGATGCCCCAGATGAG | SEQ ID NO: 890 |
| B1981890.V1.3_at | CCTGGCTCTCAGTATCAGCAGAATA | SEQ ID NO: 891 |
| B1961890.V1.3_at | GCAGTGAAGAAGTAGCCCCGCCTCA | SEQ ID NO: 892 |
| B1961890.V1.3_at | AAATGCGCGTAGTGAACTGGTTCCA | SEQ ID NO: 893 |
| B1961890.V1.3_at | AACCTTTTCTGTGTCTGGCTAATA | SEQ ID NO: 894 |
| B1961890.V1.3_at | GAGTTTATTCACTGTCTTATCTGCA | SEQ ID NO: 895 |
| B1961900.V1.3_at | GGTTTGTTTTACTTGAGCCTGCCT | SEQ ID NO: 896 |
| B1961900.V1.3_at | TGAGCCTGCCTTTGTACCCTTTTTA | SEQ ID NO: 897 |
| B1961900.V1.3_at | GAACAGAGCCACACCGGTATTATAT | SEQ ID NO: 898 |
| B1961900.V1.3_at | GTTCTATTGCGTTTGCTGACTAAAT | SEQ ID NO: 899 |
| B1961900.V1.3_at | AAAAGTCCACACAGCTCTCCTGTTT | SEQ ID NO: 900 |
| B1961900.V1.3_at | GTCTACGTTCACAGCCTCAAAAAAG | SEQ ID NO: 901 |
| B1961900.V1.3_at | AGAACACCTCCATCCTGTGATAAGT | SEQ ID NO: 902 |
| B1961900.V1.3_at | GGATTCAGCTTTACTCCTTTGTAAC | SEQ ID NO: 903 |
| B1961900.V1.3_at | GTTAAAAGGCTGACCCACGTGGCTT | SEQ ID NO: 904 |
| B1961900.V1.3_at | ACGTGGQTTTGCAGTGCTGTTCGTC | SEQ ID NO: 905 |
| B1961900.V1.3_at | GCTGTTCGTCCAGAAGCATGGCACA | SEQ ID NO: 906 |
| B1961910.V1.3_at | GACCATCCCCACTTTGCAGAAGAGG | SEQ ID NO: 907 |
| B1961910.V1.3_at | GTGTGAAGTCACTGGCCAAAGCCGG | SEQ ID NO: 908 |
| B1961910.V1.3_at | GACAGAGTGACCCAAGCCTGAGGCC | SEQ ID NO: 909 |
| B1961910.V1.3_at | GGGTCGGCTATCAGTATCCCGGCTA | SEQ ID NO: 910 |
| B1961910.V1.3_at | ATCCCGGCTACCGTGGATACCAGTA | SEQ ID NO: 911 |
| B1961910.V1.3_at | GTGGATACCAGTACCTCCTGGAGCC | SEQ ID NO: 912 |
| B1961910.V1.3_at | GCGACTACCGGCACTGGAACGAGTG | SEQ ID NO: 913 |
| B1961910.V1.3_at | TTCCAGCCACAGATGCAGGCCGTGC | SEQ ID NO: 914 |

TABLE 2-continued

| Probe Set Name | Probe Sequence | Sequence Identifier |
|---|---|---|
| B1961910.V1.3_at | TGCGCGACAGGCAGTGGCACCACAA | SEQ ID NO: 915 |
| B1961910.V1.3_at | AGTGGCACCACAAGGGCAGCTTCCC | SEQ ID NO: 916 |
| B1961910.V1.3_at | AAATGAGTCCACACTCCATGCCTGT | SEQ ID NO: 917 |
| B1961913.V1.3_at | GTACTAGCCCAAGCATCATCAATGA | SEQ ID NO: 918 |
| B1961913.V1.3_at | TGGTTTATTCCAGCTCGAGATCTCC | SEQ ID NO: 919 |
| B1961913.V1.3_at | GAGATCTCCCACAAACTATGGACCA | SEQ ID NO: 920 |
| B1961913.V1.3_at | ATCAGTGATGGCTCTTCTCTGGAAG | SEQ ID NO: 921 |
| B1961913.V1.3_at | GTGGTCAAGAGCAATCTGAACCCAA | SEQ ID NO: 922 |
| B1961913.V1.3_at | GGGCCCTCTTTTGGTGGATGTAGCA | SEQ ID NO: 923 |
| B1961913.V1.3_at | GGATGTAGCACAATTTCCACACTGT | SEQ ID NO: 924 |
| B1961913.V1.3_at | TAAAAGCTCTCTCTTGTCACTGTGT | SEQ ID NO: 925 |
| B1961913.V1.3_at | ACTGTGTTACACTTATGCATTGCCA | SEQ ID NO: 926 |
| B1961913.V1.3_at | AGTTTTGTTAGTCTTGCATGCTTAA | SEQ ID NO: 927 |
| B1961913.V1.3_at | GAATTGGCCCCATGACTTGATGTGA | SEQ ID NO: 928 |
| B1961919.V1.3_at | ATCAGTCCTGATTGCTATTTAATTT | SEQ ID NO: 929 |
| B1961919.V1.3_at | TGATGGGTTTTAAGTGTCTCATTAA | SEQ ID NO: 930 |
| B1961919.V1.3_at | GAGAGCACTGAGTGCCAGGCACTGT | SEQ ID NO: 931 |
| B1961919.V1.3_at | GGGCTCCAAGCAATTAGACAGCAAG | SEQ ID NO: 932 |
| B1961919.V1.3_at | GCAAGATCACTATTAGAGTCAGACA | SEQ ID NO: 933 |
| B1961919.V1.3_at | GTCAGACAAAGTGTGTGCACATCTT | SEQ ID NO: 934 |
| B1961919.V1.3_at | GCAGGTCAGTTGCTATTTATTGAAA | SEQ ID NO: 935 |
| B1961919.V1.3_at | ACATTTTTATGTTGAAGCTTCCCTT | SEQ ID NO: 936 |
| B1961919.V1.3_at | GAAGCTTCCCTTAGACATTTTATGT | SEQ ID NO: 937 |
| B1961919.V1.3_at | GGGCATAATGCCTGGTTTGATATTC | SEQ ID NO: 938 |
| B1961919.V1.3_at | TATGCAATGTTTCTCTATCTGGAAC | SEQ ID NO: 939 |
| B1961921.V1.3_at | TGATGGTTCTTGTTCCACGAGGGCC | SEQ ID NO: 940 |
| B1961921.V1.3_at | AAGGGCTGTGAGTATCTTCTCTCTT | SEQ ID NO: 941 |
| B1961921.V1.3_at | GGGTGCATTTACTCAGTGCCTGGCA | SEQ ID NO: 942 |
| B1961921.V1.3_at | TGGTCCGTGGGAGCTCTGAATGCAA | SEQ ID NO: 943 |
| B1961921.V1.3_at | CACGTCGGTTTAGGTCAGGTCTCAA | SEQ ID NO: 944 |
| B1961921.V1.3_at | CAGGTCTCAATTCCTTTCTATGGGA | SEQ ID NO: 945 |
| B1961921.V1.3_at | TTCGGGCCATCAATAAATCAGTACT | SEQ ID NO: 946 |
| B1961921.V1.3_at | TGTGATTAAATGCAGCCCCTGGTGC | SEQ ID NO: 947 |
| B1961921.V1.3_at | CTCTCTTTCCTTGTGACGACAGACA | SEQ ID NO: 948 |
| B1961921.V1.3_at | GACAACATGGTTTCTCTTGCCAGTG | SEQ ID NO: 949 |
| B1961921.V1.3_at | GCTGTCTGGGACTTGGTTTGTAAAA | SEQ ID NO: 950 |
| B1961922.V1.3_at | AGAACAAGTGACTCTGACCAGCAGG | SEQ ID NO: 951 |
| B1961922.V1.3_at | GACCAGCAGGTTTACCTTGTTGAAA | SEQ ID NO: 952 |

TABLE 2-continued

| Probe Set Name | Probe Sequence | Sequence Identifier |
|---|---|---|
| B1961922.V1.3_at | AATATTCCAATTCATTCTTGCCCCA | SEQ ID NO: 953 |
| B1961922.V1.3_at | GTGGAGAAGTTCTGCCCGACATAGA | SEQ ID NO: 954 |
| B1961922.V1.3_at | GCCCGACATAGATACCTTACAGATT | SEQ ID NO: 955 |
| B1961922.V1.3_at | AAGTGTCGATGTTTCACTTCCCCAA | SEQ ID NO: 956 |
| B1961922.V1.3_at | GTCAAGATTTTCTTCCTCCAAGAGT | SEQ ID NO: 957 |
| B1961922.V1.3_at | GGACATTTTTGTGGACTTCCATAA | SEQ ID NO: 958 |
| B1961922.V1.3_at | AGAATCCGTAACATACCAGTCTCCT | SEQ ID NO: 959 |
| B1961922.V1.3_at | AACGTTCAGTTTATGTGAGCACGAA | SEQ ID NO: 960 |
| B1961922.V1.3_at | ATGGAAGAAGCCTCGCTGAGAGATT | SEQ ID NO: 961 |
| B1961928.V1.3_at | TGGTCATCATCGCAGTGGGTGCCTT | SEQ ID NO: 962 |
| B1961928.V1.3_at | AGTGGGTGCCTTCCTCTTCCTGGTG | SEQ ID NO: 963 |
| B1961928.V1.3_at | TTCCTGGTGGCCTTTGTGGGCTGCT | SEQ ID NO: 964 |
| B1961928.V1.3_at | GGGCCTGCAAGGAGAACTACTGTCT | SEQ ID NO: 965 |
| B1961928.V1.3_at | GGAGAACTACTGTCTTATGATCACG | SEQ ID NO: 966 |
| B1961928.V1.3_at | ACTGTCTTATGATCACGTTTGCCGT | SEQ ID NO: 967 |
| B1961928.V1.3_at | ATGATCACGTTTGCCGTCTTCCTGT | SEQ ID NO: 968 |
| B1961928.V1.3_at | TTCCTGTCTCTTATCACGCTGGTGG | SEQ ID NO: 969 |
| B1961928.V1.3_at | TCTTATCACGCTGGTGGAGGTGGCC | SEQ ID NO: 970 |
| B1961928.V1.3_at | GTGGCCGCAGCCATAGCTGGCTATG | SEQ ID NO: 971 |
| B1961928.V1.3_at | CATAGCTGGCTATGTCTTTAGAGAC | SEQ ID NO: 972 |
| B1961932.V1.3_at | TGTTACCCGAGTCTGACCCAGTCCT | SEQ ID NO: 973 |
| B1961932.V1.3_at | AGTCCTGGGTTAGCTGCCGCCATAT | SEQ ID NO: 974 |
| B1961932.V1.3_at | GCTGCCGCCATATCACTGGATTGGA | SEQ ID NO: 975 |
| B1961932.V1.3_at | ATCACTGGATTGGATGCTGAGCCTA | SEQ ID NO: 976 |
| B1961932.V1.3_at | GATGCTGAGCCTAGAAACTGATCAA | SEQ ID NO: 977 |
| B1961932.V1.3_at | GAATGACTTAGGAGGCCCCAGGAAA | SEQ ID NO: 978 |
| B1961932.V1.3_at | AGGATTTGCCTAGAGAGGCCCGTTC | SEQ ID NO: 979 |
| B1961932.V1.3_at | GTTCCTTCAACAGAGCTTCATCTAG | SEQ ID NO: 980 |
| B1961932.V1.3_at | AGAGCTTCATCTAGCTGGCACCAGA | SEQ ID NO: 981 |
| B1961932.V1.3_at | TGGCACCAGAGGCAGGATTGCACCT | SEQ ID NO: 982 |
| B1961932.V1.3_at | TTGCACCTGTGGTGGGTGCTTAGCC | SEQ ID NO: 983 |
| B1961932.V1.3_s_at | GAAATTGTGATTAGCCGGTAGTGAC | SEQ ID NO: 984 |
| B1961932.V1.3_s_at | AGTGACAGTTTGCTGTCAGGTCCCC | SEQ ID NO: 985 |
| B1961932.V1.3_s_at | TGGGCCTCCTCTTAGGCATGGGATC | SEQ ID NO: 986 |
| B1961932.V1.3_s_at | ATGGGATCCCCAGAGTGGACCTGCC | SEQ ID NO: 987 |
| B1961932.V1.3_s_at | GCCAGTTTGTGCACCCATGGAGAGC | SEQ ID NO: 988 |
| B1961932.V1.3_s_at | ATGGAGAGCGTTGCTGGCAGCCATA | SEQ ID NO: 989 |
| B1961932.V1.3_s_at | AGGGAGTGGGTCACAGCCCATGACC | SEQ ID NO: 990 |
| B1961932.V1.3_s_at | GGCATTCCAGACAGCTGACCCGGCA | SEQ ID NO: 991 |

TABLE 2-continued

| Probe Set Name | Probe Sequence | Sequence Identifier |
|---|---|---|
| B1961932.V1.3_s_at | ACGTTTTGCCTGCACATGGCTCAGA | SEQ ID NO: 992 |
| B1961932.V1.3_s_at | AGACCTTGGGTCGAGTAACGCTTGT | SEQ ID NO: 993 |
| B1961932.V1.3_s_at | GAGTAACGCTTGTTTGTGTGTATCT | SEQ ID NO: 994 |
| B1961935.V1.3_at | TCATTGATTCCGTGTGTCACAGCAT | SEQ ID NO: 995 |
| B1961935.V1.3_at | ATTTTCTGAAGAACCGCCTCACGAG | SEQ ID NO: 996 |
| B1961935.V1.3_at | ACGAGACTCATTGTTCTGCGTGTCC | SEQ ID NO: 997 |
| B1961935.V1.3_at | GTTCTGAAATTGTCACGCTCTGTAG | SEQ ID NO: 998 |
| B1961935.V1.3_at | GAGGACACGGTTTGTTCTCTGTGCA | SEQ ID NO: 999 |
| B1961935.V1.3_at | AAGGGAGCCCTGCACCTCAGAAGGA | SEQ ID NO: 1000 |
| B1961935.V1.3_at | ATTCCCTTGCCAGTGACTAGTTCTA | SEQ ID NO: 1001 |
| B1961935.V1.3_at | TGAGACCCAATTCAGGCCGATAAGA | SEQ ID NO: 1002 |
| B1961935.V1.3_at | TCTGGGCACGCTTGAGTCTGAATGT | SEQ ID NO: 1003 |
| B1961935.V1.3_at | TACCAGCCCGATGTTGAACGCGACA | SEQ ID NO: 1004 |
| B1961935.V1.3_at | GATGGAACACACCTAAGCCCTGAGT | SEQ ID NO: 1005 |
| B1961938.V1.3_at | AGGAGCGAATCTGCAGGGTCTTCTC | SEQ ID NO: 1006 |
| B1961938.V1.3_at | CTGAGCTTTGAGGACTTTCTGGACC | SEQ ID NO: 1007 |
| B1961938.V1.3_at | GACCTCCTCAGTGTGTTCAGTGACA | SEQ ID NO: 1008 |
| B1961938.V1.3_at | ATGCCTTCCGCATCTTTGACTTTGA | SEQ ID NO: 1009 |
| B1961938.V1.3_at | GAGATGACCTGAGCCAGCTCGTGAA | SEQ ID NO: 1010 |
| B1961938.V1.3_at | CACGGCTCAGTGCTTCCGAGATGAA | SEQ ID NO: 1011 |
| B1961938.V1.3_at | GGATGGGACCATCAATCTCTCTGAG | SEQ ID NO: 1012 |
| B1961938.V1.3_at | AATCTCTCTGAGTTCCAGCATGTCA | SEQ ID NO: 1013 |
| B1961938.V1.3_at | ACCAGACTTTGCAAGCTCCTTTAAG | SEQ ID NO: 1014 |
| B1961938.V1.3_at | GCTCCTTTAAGATTGTCCTGTGACA | SEQ ID NO: 1015 |
| B1961938.V1.3_at | GACCAAGGTCATGCCTGTGTTGCCA | SEQ ID NO: 1016 |
| B1961940.V1.3_at | GAGCGGCACGAGTCTCAGACCTGAA | SEQ ID NO: 1017 |
| B1961940.V1.3_at | GCATGGACCGGATAGACTCTTGACT | SEQ ID NO: 1018 |
| B1961940.V1.3_at | TTCTGCCCACAGTTTGTGATCTGCA | SEQ ID NO: 1019 |
| B1961940.V1.3_at | TGCAGAGTCCAGCTAGGGTAACCCT | SEQ ID NO: 1020 |
| B1961940.V1.3_at | GAGCCAAAGTTTTCTCATTCTCCCT | SEQ ID NO: 1021 |
| B1961940.V1.3_at | AAATTCTCTCCATCTTTTCGGTG | SEQ ID NO: 1022 |
| B1961940.V1.3_at | TTTTCGGTGCATTGGCCATGTTACT | SEQ ID NO: 1023 |
| B1961940.V1.3_at | GCCATGTTACTGTGCCAATAGTGTC | SEQ ID NO: 1024 |
| B1961940.V1.3_at | TAATTCTTGTTCCATCTGTTCTCAG | SEQ ID NO: 1025 |
| B1961940.V1.3_at | GCCTTGAACCCCACATAGGAGTTGT | SEQ ID NO: 1026 |
| B1961940.V1.3_at | GTTACTCCTTGTAGTTGATCCTGAT | SEQ ID NO: 1027 |
| B1961941.V1.3_at | TGAAGCCCAATATGGTAACCCCAGG | SEQ ID NO: 1028 |
| B1961941.V1.3_at | GATTGCCATGGCAACTGTCACGGCA | SEQ ID NO: 1029 |

TABLE 2-continued

| Probe Set Name | Probe Sequence | Sequence Identifier |
|---|---|---|
| B1961941.V1.3_at | TGGGATCACCTTCCTATCTGGAGGC | SEQ ID NO: 1030 |
| B1961941.V1.3_at | AGGAGGAGGCATCCATCAACCTCAA | SEQ ID NO: 1031 |
| B1961941.V1.3_at | GGAATATGTCAAGCGAGCCCTGGCC | SEQ ID NO: 1032 |
| B1961941.V1.3_at | AAATACACCCCAAGTGGTCACGCTG | SEQ ID NO: 1033 |
| B1961941.V1.3_at | TTCATCTCTAACCATGCCTACTAAG | SEQ ID NO: 1034 |
| B1961941.V1.3_at | AGTGGAGGTATTCTAAGGCTGCCCC | SEQ ID NO: 1035 |
| B1961941.V1.3_at | AGGGCTTTAGGCTGTTCTTTCCCAT | SEQ ID NO: 1036 |
| B1961941.V1.3_at | TTGCCTCCCTGGTGACATTGGTCTG | SEQ ID NO: 1037 |
| B1961941.V1.3_at | GTCTGTGGTATTGTCTGTGTATGCT | SEQ ID NO: 1038 |
| B1961946.V1.3_at | TTCATCATGCTCATCATACTCGTAC | SEQ ID NO: 1039 |
| B1961946.V1.3_at | TTGCCCCTTCGAAGAAATCACGTCA | SEQ ID NO: 1040 |
| B1961946.V1.3_at | GGCACTCACACTTGGGCAGCATGTA | SEQ ID NO: 1041 |
| B1961946.V1.3_at | ATACATGTATCTATCTGTCCCTTCA | SEQ ID NO: 1042 |
| B1961946.V1.3_at | GTGTTTTTGTAGACTTCTGACCCAG | SEQ ID NO: 1043 |
| B1961946.V1.3_at | AAGAACGTACCATTGACTCAGCTCC | SEQ ID NO: 1044 |
| B1961946.V1.3_at | TGTTGGTACTCCCAGCAATGTCTAG | SEQ ID NO: 1045 |
| B1961946.V1.3_at | CAATGTCTAGCTGTGTGACCTTAGG | SEQ ID NO: 1046 |
| B1961946.V1.3_at | TTCTTCTATGAGATGGCGGCCACGA | SEQ ID NO: 1047 |
| B1961946.V1.3_at | AAAGGATGTGTAGCAGACCCCTGCC | SEQ ID NO: 1048 |
| B1961946.V1.3_at | TGGCAGGTACTCAGTTGATCGTCGA | SEQ ID NO: 1049 |
| BM734452.V1.3_at | CCGACTCCAGCAGCACGTAGAAGTG | SEQ ID NO: 1050 |
| BM734452.V1.3_at | AGACTTTCCCAGGTTCGGGAGCTGC | SEQ ID NO: 1051 |
| BM734452.V1.3_at | GCTGCTGTGTCCAGAGGTGGCATTT | SEQ ID NO: 1052 |
| BM734452.V1.3_at | GGCATTTGACTATTTTGACCAGGA | SEQ ID NO: 1053 |
| BM734452.V1.3_at | GTAAGCGCGAGGAAATCCTTTTTAT | SEQ ID NO: 1054 |
| BM734452.V1.3_at | TTTTATTGTATTATCTTCCCTCCCT | SEQ ID NO: 1055 |
| BM734452.V1.3_at | GGCTGCTGGGTCTGTTGTCAGTCCT | SEQ ID NO: 1056 |
| BM734452.V1.3_at | TGTCAGTCCTGCTGCTAACCTGGCA | SEQ ID NO: 1057 |
| BM734452.V1.3_at | GCCGTGAGCTGCCATGTGCTTCTCA | SEQ ID NO: 1058 |
| BM734452.V1.3_at | CTCAGAGCTGCCCAAGTGGAGGCTC | SEQ ID NO: 1059 |
| BM734452.V1.3_at | AAGTGGAGGCTCTAGCTGACTGCCT | SEQ ID NO: 1060 |
| BM734454.V1.3_at | GAGAAACTCCATTCTACCACTATGA | SEQ ID NO: 1061 |
| BM734454.V1.3_at | GTGTTCCTTTCGTTTTGGGTATCAT | SEQ ID NO: 1062 |
| BM734454.V1.3_at | GTTTTGGGTATCATCTTCCTGACTC | SEQ ID NO: 1063 |
| BM734454.V1.3_at | ATCATCTTCCTGACTCTGATTGGAG | SEQ ID NO: 1064 |
| BM734454.V1.3_at | GAGTTCAAGGAGCTCCAGTAATGAG | SEQ ID NO: 1065 |
| BM734454.V1.3_at | AAGGGACGCTGTTCCTGCATCAAGA | SEQ ID NO: 1066 |
| BM734454.V1.3_at | GCATCAAGACCAGCCAAGGGACGAT | SEQ ID NO: 1067 |
| BM734454.V1.3_at | GACGATCCGCCCAAAACTGTTAAAG | SEQ ID NO: 1068 |

TABLE 2-continued

| Probe Set Name | Probe Sequence | Sequence Identifier |
|---|---|---|
| BM734454.V1.3_at | TTAAACAGTTTGCTCCAAGCCCTTC | SEQ ID NO: 1069 |
| BM734454.V1.3_at | CAAGCCCTTCTTGTGAGACAACTGA | SEQ ID NO: 1070 |
| BM734454.V1.3_at | GTCTAAACCCAGATTCAGCAGAAGT | SEQ ID NO: 1071 |
| BM734455.V1.3_at | GGGACAGCCTGCTTGGCCATTGCAA | SEQ ID NO: 1072 |
| BM734455.V1.3_at | CTGCTTGGCCATTGCAAGCGGCATT | SEQ ID NO: 1073 |
| BM734455.V1.3_at | ATTGCAAGCGGCATTTACCTGCTGG | SEQ ID NO: 1074 |
| BM734455.V1.3_at | AAGCGGCATTTACCTGCTGGCGGCC | SEQ ID NO: 1075 |
| BM734455.V1.3_at | CCGTCCGTGGTGAGCAGTGGACCCC | SEQ ID NO: 1076 |
| BM734455.V1.3_at | CCCCAGCCGAGGTTTGCAAGAAGCT | SEQ ID NO: 1077 |
| BM734455.V1.3_at | AGGTTTGCAAGAAGCTCAGCGAGGA | SEQ ID NO: 1078 |
| BM734455.V1.3_at | AGCGAGGAGGAGTCCGCGGCCGCCA | SEQ ID NO: 1079 |
| BM734455.V1.3_at | ATCCCGGTGACCGATGAGGTTGTGT | SEQ ID NO: 1080 |
| BM734455.V1.3_at | GTGACGGTGTGTGACCAGAGCCTCA | SEQ ID NO: 1081 |
| BM734455.V1.3_at | TGTGTGACCAGAGCCTCAAACCGCT | SEQ ID NO: 1082 |
| BM734457.V1.3_at | AGGCCCTACGGCTATGCCTGGCAGG | SEQ ID NO: 1083 |
| BM734457.V1.3_at | AGATCTGCAAGGTGGCAGTGGCCAC | SEQ ID NO: 1084 |
| BM734457.V1.3_at | GGCAGTGGCCACTCTGAGCCATGAG | SEQ ID NO: 1085 |
| BM734457.V1.3_at | TGAGCCATGAGCAGATGATTGATCT | SEQ ID NO: 1086 |
| BM734457.V1.3_at | GATTGATCTGCTGAGAACATCCGTC | SEQ ID NO: 1087 |
| BM734457.V1.3_at | CTGCTGAGAACATCCGTCACGGTGA | SEQ ID NO: 1088 |
| BM734457.V1.3_at | CACGGTGAAGGTGGTCATTATCCCC | SEQ ID NO: 1089 |
| BM734457.V1.3_at | ATGATGACTGCACCCCACGGAGGAG | SEQ ID NO: 1090 |
| BM734457.V1.3_at | ACCCCACGGAGGAGTTGCTCTGAAA | SEQ ID NO: 1091 |
| BM734457.V1.3_at | AGGAGTTGCTCTGAAACCTACCGCA | SEQ ID NO: 1092 |
| BM734457.V1.3_at | AACCTACCGCATGCCAGTGATGGAA | SEQ ID NO: 1093 |
| BM734458.V1.3_at | GATTCCTTCCAGCTGAGAGGATTAG | SEQ ID NO: 1094 |
| BM734458.V1.3_at | AATGGAAGGGTTGGGAGCACTTTCT | SEQ ID NO: 1095 |
| BM734458.V1.3_at | GGGCATACTCCTGAAGCCAGTTTTG | SEQ ID NO: 1096 |
| BM734458.V1.3_at | GTTTTGAAAAGCTCAATGGCACCAG | SEQ ID NO: 1097 |
| BM734458.V1.3_at | AATGGCACCAGAAAAGCAGTAAGAC | SEQ ID NO: 1098 |
| BM734458.V1.3_at | CTGGGCTAGATCAGAGAGGTCTCTC | SEQ ID NO: 1099 |
| BM734458.V1.3_at | ATCAGAGAGGTCTCTCGGGCTGTGC | SEQ ID NO: 1100 |
| BM734458.V1.3_at | AACAGCGGGCTCTGAGTTGTGTCTT | SEQ ID NO: 1101 |
| BM734458.V1.3_at | GCGGGCTCTGAGTTGTGTCTTAGAA | SEQ ID NO: 1102 |
| BM734458.V1.3_at | AGAAGAGTCTCTTTGGCGTGGTCCA | SEQ ID NO: 1103 |
| BM734458.V1.3_at | TTGGCGTGGTCCACAGGACAGAGTT | SEQ ID NO: 1104 |
| BM734459.V1.3_at | ATTGTTGATGAGCTGTTTCCGCGTC | SEQ ID NO: 1105 |
| BM734459.V1.3_at | GATCAACAAGCTCCATCTGTGCAAA | SEQ ID NO: 1106 |

TABLE 2-continued

| Probe Set Name | Probe Sequence | Sequence Identifier |
|---|---|---|
| BM734459.V1.3_at | GAGAGACGATTACAGCACCGCGCAG | SEQ ID NO: 1107 |
| BM734459.V1.3_at | AAGCGGAGGAGTACCTGTCCTTCGC | SEQ ID NO: 1108 |
| BM734459.V1.3_at | GATGATTCTGATATACCTGCTTCCA | SEQ ID NO: 1109 |
| BM734459.V1.3_at | AAATGCTGCTGGGTCATATGCCAAC | SEQ ID NO: 1110 |
| BM734459.V1.3_at | ATATGCCAACCATTGAGCTCTTGAA | SEQ ID NO: 1111 |
| BM734459.V1.3_at | AGTACCATCTCATGCAGTTTGCTGA | SEQ ID NO: 1112 |
| BM734459.V1.3_at | TGTAAGCGAAGGCAATCTCCTCCTG | SEQ ID NO: 1113 |
| BM734459.V1.3_at | GAACGAGGCTCTCACAAAGCACGAG | SEQ ID NO: 1114 |
| BM734459.V1.3_at | AAAGCACGAGACCTTCTTCATTCGC | SEQ ID NO: 1115 |
| BM734461.V1.3_at | GGCTAGAGGATGACCGTGCGTGGCA | SEQ ID NO: 1116 |
| BM734461.V1.3_at | AGGGCGCCGCCGACGGAGGCATGAT | SEQ ID NO: 1117 |
| BM734461.V1.3_at | GAGGCATGATGGACAGGGACCACAA | SEQ ID NO: 1118 |
| BM734461.V1.3_at | AGAAGTATGTCTGGTCACTCGGGCC | SEQ ID NO: 1119 |
| BM734461.V1.3_at | GCCACATGATGACCCGCGGCGGGAT | SEQ ID NO: 1120 |
| BM734461.V1.3_at | ATGCAGGGCGGCTTCGGAGGCCAGA | SEQ ID NO: 1121 |
| BM734461.V1.3_at | TTAGGAGCCCCTTCAACTGTGTACA | SEQ ID NO: 1122 |
| BM734461.V1.3_at | GCCCCTTCAACTGTGTACAATACGT | SEQ ID NO: 1123 |
| BM734461.V1.3_at | TTTTTTATCTGCTGCCATATTGTAG | SEQ ID NO: 1124 |
| BM734461.V1.3_at | ATCTGCTGCCATATTGTAGCTCAAT | SEQ ID NO: 1125 |
| BM734461.V1.3_at | GTAGCTCAATACAATGTGAATTTGT | SEQ ID NO: 1126 |
| BM734464.V1.3_at | GGACAAGCGTGTCAACGACCTGTTC | SEQ ID NO: 1127 |
| BM734464.V1.3_at | GTGTCAACGACCTGTTCCGCATCAT | SEQ ID NO: 1128 |
| BM734464.V1.3_at | ATCATCCCCGGCATTGGGAACTTCG | SEQ ID NO: 1129 |
| BM734464.V1.3_at | GCATTGGGAACTTCGGTGACCGTTA | SEQ ID NO: 1130 |
| BM734464.V1.3_at | GTGACCGTTACTTTGGGACCGATGC | SEQ ID NO: 1131 |
| BM734464.V1.3_at | GACCGATGCTGTCCCTGATGGCAGT | SEQ ID NO: 1132 |
| BM734464.V1.3_at | ATGCTGTCCCTGATGGCAGTGACGA | SEQ ID NO: 1133 |
| BM734464.V1.3_at | AAGTGGCTTCCACGAGTTAGCTGTG | SEQ ID NO: 1134 |
| BM734464.V1.3_at | AGTTAGCTGTGCAGGCTGAGCCACC | SEQ ID NO: 1135 |
| BM734464.V1.3_at | TTGGCTCTTGCTTTCCGAGTACAGA | SEQ ID NO: 1136 |
| BM734464.V1.3_at | CTTGCTTTCCGAGTACAGAGATGTT | SEQ ID NO: 1137 |
| BM734465.V1.3_at | ACCGGTGGGTCTTTAGCATCTGCAG | SEQ ID NO: 1138 |
| BM734465.V1.3_at | TAGGTGGTCCGTGTCTCATCCAAGA | SEQ ID NO: 1139 |
| BM734465.V1.3_at | TCCAAGACTGATGAGGCCTGCTGCA | SEQ ID NO: 1140 |
| BM734465.V1.3_at | AAGCTGACATCATCGGCCACAGGGA | SEQ ID NO: 1141 |
| BM734465.V1.3_at | AAGAGCGCGTCATAGTCCCGGAGGA | SEQ ID NO: 1142 |
| BM734465.V1.3_at | GGAACCTCTTCTCCTGAAGCAAGGA | SEQ ID NO: 1143 |
| BM734465.V1.3_at | GGAACTCTTCGATGAAGCCCTGAAT | SEQ ID NO: 1144 |
| BM734465.V1.3_at | GAATGTTGTCACAGCTGCTTTCCAA | SEQ ID NO: 1145 |

TABLE 2-continued

| Probe Set Name | Probe Sequence | Sequence Identifier |
|---|---|---|
| BM734465.V1.3_at | GAATGGGAGAGCCTCTGCCACAAGT | SEQ ID NO: 1146 |
| BM734465.V1.3_at | AAGCCTCCTCTTCTTAATTGCAGAC | SEQ ID NO: 1147 |
| BM734465.V1.3_at | AATTGCAGACTCCAGTTCGGGAACT | SEQ ID NO: 1148 |
| BM734478.V1.3_at | TACAGCCCCTGGACCTTTTGAAGGA | SEQ ID NO: 1149 |
| BM734478.V1.3_at | GAGTCTGGCTCCCAGGCTGAAGAAA | SEQ ID NO: 1150 |
| BM734478.V1.3_at | TATACTCGGCCACAGCTAAAGCTTT | SEQ ID NO: 1151 |
| BM734478.V1.3_at | TTTCACTTTTCTCCTTCGGAAGCAA | SEQ ID NO: 1152 |
| BM734478.V1.3_at | GCAAAACTGGCCTGTACGAGATCCC | SEQ ID NO: 1153 |
| BM734478.V1.3_at | GATCCCCTGTTAAAACTTCTCGGCG | SEQ ID NO: 1154 |
| BM734478.V1.3_at | AATTGTTGTATTTCTCTCTGCTTCC | SEQ ID NO: 1155 |
| BM734478.V1.3_at | TAACAGCTTTGTGATGTTCCCGCTT | SEQ ID NO: 1156 |
| BM734478.V1.3_at | TTTCTTTCTTCCTAACAGCCAGATT | SEQ ID NO: 1157 |
| BM734478.V1.3_at | CAGCCAGATTGCTTTTCCCATAAAG | SEQ ID NO: 1158 |
| BM734478.V1.3_at | TTGAGAATCTCAAGCCATGTGCATT | SEQ ID NO: 1159 |
| BM734480.V1.3_at | AATGCTTTGCAAGTCCTGTGCCAAA | SEQ ID NO: 1160 |
| BM734480.V1.3_at | AAAGCTGGCCTGAGGACCACTTGCA | SEQ ID NO: 1161 |
| BM734480.V1.3_at | TAGGCACAGCAGCAGTAGCTCCTTT | SEQ ID NO: 1162 |
| BM734480.V1.3_at | TTCCATTATCTCCTTCAACTCAGAA | SEQ ID NO: 1163 |
| BM734480.V1.3_at | AGAAAGGGTTTCTGTCTCCAGCCAC | SEQ ID NO: 1164 |
| BM734480.V1.3_at | GGCGAGACCCCTTGATTGGCAAAGA | SEQ ID NO: 1165 |
| BM734480.V1.3_at | AGACCCGACATGTTTTAGGCCCTCA | SEQ ID NO: 1166 |
| BM734480.V1.3_at | GCCCTCACCAGTGTTGTCTTAGGTA | SEQ ID NO: 1167 |
| BM734480.V1.3_at | GTCTTAGGTATCAACTGCTGCTCTG | SEQ ID NO: 1168 |
| BM734480.V1.3_at | AGCCAGCCTATTTTTCAGTGCACAT | SEQ ID NO: 1169 |
| BM734480.V1.3_at | CAAGGTGCTATCTGCTCTGGAAGTT | SEQ ID NO: 1170 |
| BM734482.V1.3_at | ATTTCCTGTGGTGTTCATTTTGAGC | SEQ ID NO: 1171 |
| BM734482.V1.3_at | TAGCAAACCTTCTATGCTCTCAGTG | SEQ ID NO: 1172 |
| BM734482.V1.3_at | TCAGTGCTTCCCAGAGAACATCAGG | SEQ ID NO: 1173 |
| BM734482.V1.3_at | AGATTCTCACGTGCCTTTGGGATCG | SEQ ID NO: 1174 |
| BM734482.V1.3_at | GAAGGGTTCAACAACACGAGGTCTT | SEQ ID NO: 1175 |
| BM734482.V1.3_at | ACGAGGTCTTGATCTGGACTTCAGA | SEQ ID NO: 1176 |
| BM734482.V1.3_at | GAATCAATGGTGCTGTGCTGTCAAT | SEQ ID NO: 1177 |
| BM734482.V1.3_at | TGCTGTCAATGGCTACTCGGTGGAA | SEQ ID NO: 1178 |
| BM734482.V1.3_at | AAGGGTTGCCCCAGAATAAATCTCT | SEQ ID NO: 1179 |
| BM734482.V1.3_at | AAATCTCTGGATTAACTCTCCCGGG | SEQ ID NO: 1180 |
| BM734482.V1.3_at | GCAGGGTGCCGTTTCGGTACCAAGA | SEQ ID NO: 1181 |
| BM734485.V1.3_at | GACACAAACTTTCAGACCATAGCAA | SEQ ID NO: 1182 |
| BM734485.V1.3_at | TGTATGACAAGGACTGCCAGGCCCA | SEQ ID NO: 1183 |

TABLE 2-continued

| Probe Set Name | Probe Sequence | Sequence Identifier |
|---|---|---|
| BM734485.V1.3_at | AGGCCCATCCATTAACGCTAGTTGG | SEQ ID NO: 1184 |
| BM734485.V1.3_at | TTAACGCTAGTTGGGTTCACTCCTC | SEQ ID NO: 1185 |
| BM734485.V1.3_at | ATCTCAAATTTCCTCGATTTCACCA | SEQ ID NO: 1186 |
| BM734485.V1.3_at | GATTTCACCAAGAGCCTATTGCCTT | SEQ ID NO: 1187 |
| BM734485.V1.3_at | GAGCCTATTGCCTTCAAGTTTTTAT | SEQ ID NO: 1188 |
| BM734485.V1.3_at | AAATGTCTGGATTTTCAGCTTCTGT | SEQ ID NO: 1189 |
| BM734485.V1.3_at | GTGGGACTGTTCTCCAAACACGGGA | SEQ ID NO: 1190 |
| BM734485.V1.3_at | TGCTGGACAGCCCAACTGAATGGTG | SEQ ID NO: 1191 |
| BM734485.V1.3_at | GGTGATACTGACCACACTTGCCATA | SEQ ID NO: 1192 |
| BM734496.V1.3_at | TGGGTTGCTGCCACAACATGGCTGC | SEQ ID NO: 1193 |
| BM734496.V1.3_at | GAGTGATGTGGGTCCACACCCAGGA | SEQ ID NO: 1194 |
| BM734496.V1.3_at | GGAGCTGAACCCTGGGCTGCTGAAT | SEQ ID NO: 1195 |
| BM734496.V1.3_at | GCCAGCCCCTACAAGTCATTTTTTA | SEQ ID NO: 1196 |
| BM734496.V1.3_at | ACTTTCAGTGACATAGGCTGCCTTT | SEQ ID NO: 1197 |
| BM734496.V1.3_at | GGCTGCCTTTTCTAAACTAATCCTT | SEQ ID NO: 1198 |
| BM734496.V1.3_at | ACAGAGTCTTGATTTCTGCACCCCA | SEQ ID NO: 1199 |
| BM734496.V1.3_at | GCACCCCATCTTTACCTTTGAGGAA | SEQ ID NO: 1200 |
| BM734496.V1.3_at | GGCCAGCCCGGTGATCTAATGATTA | SEQ ID NO: 1201 |
| BM734496.V1.3_at | AAGTTTGCACACTCCACTTCAGTGG | SEQ ID NO: 1202 |
| BM734496.V1.3_at | AGTGGCCTGGGATTCACCAGTTCAG | SEQ ID NO: 1203 |
| BM734501.V1.3_at | AAGAGAATGTAGTTCCCTCCTCAGG | SEQ ID NO: 1204 |
| BM734501.V1.3_at | CAGGCTTTCGTGGTTAGCTTACCGA | SEQ ID NO: 1205 |
| BM734501.V1.3_at | GGTACAAGCCGAGCTGCCAGGGAAT | SEQ ID NO: 1206 |
| BM734501.V1.3_at | ACAGTCTTGCTGTCCAGGGAACCAA | SEQ ID NO: 1207 |
| BM734501.V1.3_at | GTCCGTTTTCAGTTCTATCTCCAAA | SEQ ID NO: 1208 |
| BM734501.V1.3_at | TAACAGGCCCTTGGCACAGCAAGAT | SEQ ID NO: 1209 |
| BM734501.V1.3_at | AGCAAGATCCTTTCTGCAGGCTGAT | SEQ ID NO: 1210 |
| BM734501.V1.3_at | AAAAACGATTCTGTCTCCTTCAAAG | SEQ ID NO: 1211 |
| BM734501.V1.3_at | GAGTACTTGTTTTCTGACTTGTCCA | SEQ ID NO: 1212 |
| BM734501.V1.3_at | AATGCACTATGCTTGATCGCCGATT | SEQ ID NO: 1213 |
| BM734501.V1.3_at | GTATAACGTCGTTGCCTTTATTTGT | SEQ ID NO: 1214 |
| BM734502.V1.3_at | ATGAGCTGGAGGCACTTCTACCTTT | SEQ ID NO: 1215 |
| BM734502.V1.3_at | TACCTTTGTGGGTCCCTTATTCTAT | SEQ ID NO: 1216 |
| BM734502.V1.3_at | GACTTCTAAAAGCTCATGGGCCCTA | SEQ ID NO: 1217 |
| BM734502.V1.3_at | GGCCCTGCCATTACGTGGATACTGT | SEQ ID NO: 1218 |
| BM734502.V1.3_at | GGATACTGTGCCTTTAGCTGTAACA | SEQ ID NO: 1219 |
| BM734502.V1.3_at | TAACACCGAGCCTGTATCCTTTAAT | SEQ ID NO: 1220 |
| BM734502.V1.3_at | TGATTTCATTCAGGCATGCTCATCT | SEQ ID NO: 1221 |
| BM734502.V1.3_at | AAATGGGACCCAGCTCTCTTGGTGA | SEQ ID NO: 1222 |

TABLE 2-continued

| Probe Set Name | Probe Sequence | Sequence Identifier |
|---|---|---|
| BM734502.V1.3_at | GTGAGCCAGGATCTCTTTACGTTTA | SEQ ID NO: 1223 |
| BM734502.V1.3_at | TATTGTTTTAACTCTCTTCCCAGGT | SEQ ID NO: 1224 |
| BM734502.V1.3_at | TTCAAACTTTTCTGATCCCAGCCTA | SEQ ID NO: 1225 |
| BM734506.V1.3_at | GAACCTGTTGGATGACCTTGTAACT | SEQ ID NO: 1226 |
| BM734506.V1.3_at | GAGAGAGACTACTTCTGGCATCCTT | SEQ ID NO: 1227 |
| BM734506.V1.3_at | AGAACCAGATCTCATCAGGTCCAGC | SEQ ID NO: 1228 |
| BM734506.V1.3_at | TAAGCGAGGAGTACCCAACCCTTGG | SEQ ID NO: 1229 |
| BM734506.V1.3_at | GATGAAATCCGGCAGCAGCAGCAGA | SEQ ID NO: 1230 |
| BM734506.V1.3_at | TTTCCTCCATCATAAGTCGCCAGAA | SEQ ID NO: 1231 |
| BM734506.V1.3_at | ATGACCTTGCCAACCTGGTGGAGAA | SEQ ID NO: 1232 |
| BM734506.V1.3_at | GATTTTATTGCTGCTCGTGGCTATT | SEQ ID NO: 1233 |
| BM734506.V1.3_at | GTGGCTATTGTGGTCGTCGCAGTCT | SEQ ID NO: 1234 |
| BM734506.V1.3_at | TCGCAGTCTGGCCTACCAAGTAGTG | SEQ ID NO: 1235 |
| BM734506.V1.3_at | AGTTCAGTGCCCTTTTGGTACACGA | SEQ ID NO: 1236 |
| BM734508.V1.3_at | AGGTCTCCGTCTGCTTTCTTTTTTG | SEQ ID NO: 1237 |
| BM734508.V1.3_at | AGGCTTTAGGCCACAGGCAGCTTCT | SEQ ID NO: 1238 |
| BM734508.V1.3_at | CAAGGTGGCCAGATGGTTCCAGGAC | SEQ ID NO: 1239 |
| BM734508.V1.3_at | GTTCCAGGACCACAGTGTCTTTATT | SEQ ID NO: 1240 |
| BM734508.V1.3_at | ATTTTTAACTGTTTGCCACTGCTGC | SEQ ID NO: 1241 |
| BM734508.V1.3_at | TGGAGTACTCTCTGCCCCAGACTAG | SEQ ID NO: 1242 |
| BM734508.V1.3_at | GCCCCAGACTAGCAGGAGTGAGTTC | SEQ ID NO: 1243 |
| BM734508.V1.3_at | AGCGCTGATTCTCCCCGCAGTGTTG | SEQ ID NO: 1244 |
| BM734508.V1.3_at | GGGCATACCTTCTAACTGAGCAGTA | SEQ ID NO: 1245 |
| BM734508.V1.3_at | GCACGAGCCTGGGAACTGCTTTTAT | SEQ ID NO: 1246 |
| BM734508.V1.3_at | AATTTATCTCTGTGACCTGCTAGGG | SEQ ID NO: 1247 |
| BM734510.V1.3_at | ACGAGCGGCACGAGCCGAAGATGGC | SEQ ID NO: 1248 |
| BM734510.V1.3_at | GCGGCACGAGCCGAAGATGGCGGAG | SEQ ID NO: 1249 |
| BM734510.V1.3_at | GGGCAGGTCCTGGTGCTGGATGGCC | SEQ ID NO: 1250 |
| BM734510.V1.3_at | CAGGTCCTGGTGCTGGATGGCCGGG | SEQ ID NO: 1251 |
| BM734510.V1.3_at | GCCTGGCGGCCATCGTGGQCAAGCA | SEQ ID NO: 1252 |
| BM734510.V1.3_at | GCCATCGTGGCCAAGCAGGTGCTGC | SEQ ID NO: 1253 |
| BM734510.V1.3_at | CCATCGTGGCCAAGCAGGTGCTGCT | SEQ ID NO: 1254 |
| BM734510.V1.3_at | CATCGTGGCCAAGCAGGTGCTGCTG | SEQ ID NO: 1255 |
| BM734510.V1.3_at | AAGCAGGTGCTGCTGGGCCGGAAGG | SEQ ID NO: 1256 |
| BM734510.V1.3_at | GCTGCTGGGCCGGAAGGTGGTGGTC | SEQ ID NO: 1257 |
| BM734510.V1.3_at | CTTCCTCCGCAAGCCTACACGAAAG | SEQ ID NO: 1258 |
| BM734511.V1.3_at | ATCTCTTTCCTCATTTTCCTGATAG | SEQ ID NO: 1259 |
| BM734511.V1.3_at | GATGAGGATGGCCTTCCTGTTTCAC | SEQ ID NO: 1260 |

TABLE 2-continued

| Probe Set Name | Probe Sequence | Sequence Identifier |
|---|---|---|
| BM734511.V1.3_at | ATCTTCTCAATCTTTCTTTACCGGG | SEQ ID NO: 1261 |
| EM734511.V1.3_at | AATACGCTTGGCACTGATGGGCACT | SEQ ID NO: 1262 |
| BM734511.V1.3_at | CAGACCCCGGATGCTATTTATTCAA | SEQ ID NO: 1263 |
| BM734511.V1.3_at | GTTTGAATGAGTCCTTCGTGGGCCA | SEQ ID NO: 1264 |
| BM734511.V1.3_at | AGGCTTATCTTTTTGTCTAGTGCAA | SEQ ID NO: 1265 |
| BM734511.V1.3_at | TTTACCTAAATACTTCCAGCTCCTT | SEQ ID NO: 1266 |
| BM734511.V1.3_at | AAGCTCAGTACACTAATGCCTCATC | SEQ ID NO: 1267 |
| BM734511.V1.3_at | ATGCCTCATCTTAGCAGTGATTTTG | SEQ ID NO: 1268 |
| BM734511.V1.3_at | AAACCTGACTGAGTTTTCCTGTCTA | SEQ ID NO: 1269 |
| BM734513.V1.3_at | GAGGCTTGAAAACACACCACATTGA | SEQ ID NO: 1270 |
| BM734513.V1.3_at | ACCACATTGAAAATCCTGCCACAGC | SEQ ID NO: 1271 |
| BM734513.V1.3_at | TAAGCACTGGCTTCGTAGGAAACCA | SEQ ID NO: 1272 |
| BM734513.V1.3_at | CATACGCCGGCCGTCTTGGAAAAGA | SEQ ID NO: 1273 |
| BM734513.V1.3_at | AGAACTAGCTTTTCTGCCTTTTGGC | SEQ ID NO: 1274 |
| BM734513.V1.3_at | GCCTGGCCTTTGCTACTGGTAAGAA | SEQ ID NO: 1275 |
| BM734513.V1.3_at | AAGATGGAGCCTGGGTCTCAAGCCC | SEQ ID NO: 1276 |
| BM734513.V1.3_at | TGTACCTTTGCCACACTGTATGTGT | SEQ ID NO: 1277 |
| BM734513.V1.3_at | GAGGCTGAGGGATTCTTTCCAGTCT | SEQ ID NO: 1278 |
| BM734513.V1.3_at | GGTATCCACATTCTCAACTTCAAGT | SEQ ID NO: 1279 |
| BM734513.V1.3_at | AGTCATTGCAGTTTCTTTTTCCCAG | SEQ ID NO: 1280 |
| BM734514.V1.3_at | ACGTGTTCAGGGTTTGGTTGGCTCA | SEQ ID NO: 1281 |
| BM734514.V1.3_at | GGTTGGCTCAACTCCAAACTCAATA | SEQ ID NO: 1282 |
| BM734514.V1.3_at | TGATTACCAATATGATCTCCCGTCC | SEQ ID NO: 1283 |
| BM734514.V1.3_at | TGATCTCCCGTCCAGTAGCGTGGGA | SEQ ID NO: 1284 |
| BM734514.V1.3_at | AGGTATTTCCTCTGTGGTGCCATAG | SEQ ID NO: 1285 |
| BM734514.V1.3_at | GGAGCAGTTCCATCTCACTGTGTAA | SEQ ID NO: 1286 |
| BM734514.V1.3_at | ACGAATTGGAAAGCCGACCCGCAAG | SEQ ID NO: 1287 |
| BM734514.V1.3_at | GACCCGCAAGGGAGCTTGTCTATTG | SEQ ID NO: 1288 |
| BM734514.V1.3_at | AAGGAACCTTTGATAGCCGCTGTAT | SEQ ID NO: 1289 |
| BM734514.V1.3_at | TTTGATAGCCGCTGTATCTGCTCAG | SEQ ID NO: 1290 |
| BM734514.V1.3_at | TATCTGCTCAGCCATGTCCACATTT | SEQ ID NO: 1291 |
| BM734515.V1.3_at | GTGCCGGCTCATTCAGCCAGAAAAT | SEQ ID NO: 1292 |
| BM734515.V1.3_at | CAGAAAATAAATCTCCCACCCGTGT | SEQ ID NO: 1293 |
| BM734515.V1.3_at | TCCCACCCGTGTTTGACTTTGAAGA | SEQ ID NO: 1294 |
| BM734515.V1.3_at | ACTTTGAAGACTCCACCAGGTCGTG | SEQ ID NO: 1295 |
| BM734515.V1.3_at | GAGAGCTTGGGAACTGCGATAACTT | SEQ ID NO: 1296 |
| BM734515.V1.3_at | GCGATAACTTTCTGGGAGCTTTGGT | SEQ ID NO: 1297 |
| BM734515.V1.3_at | TCTCCGTACACGCATGACACATGTT | SEQ ID NO: 1298 |
| BM734515.V1.3_at | CATGTTCGCCATATTACGTTTTATC | SEQ ID NO: 1299 |

TABLE 2-continued

| Probe Set Name | Probe Sequence | Sequence Identifier |
|---|---|---|
| BM734515.V1.3_at | TATAACAAACACACACCCTACATTT | SEQ ID NO: 1300 |
| BM734515.V1.3_at | TTCACATGGTTCTTAGGCCACATCC | SEQ ID NO: 1301 |
| BM734515.V1.3_at | GGCCACATCCCTCTTTATAAAAATT | SEQ ID NO: 1302 |
| BM734516.V1.3_at | GGGCCTGTTAGGTCATCTGTTTCAG | SEQ ID NO: 1303 |
| BM734516.V1.3_at | GTTTCAGCATTTGTCAACTTCTTGA | SEQ ID NO: 1304 |
| BM734516.V1.3_at | GGAAAATCTTCAATGGCTTCAACCA | SEQ ID NO: 1305 |
| BM734516.V1.3_at | ACCAAGTCTTGGCAGCACTGTGCAA | SEQ ID NO: 1306 |
| BM734516.V1.3_at | TAGACTCATTTTTCAGGCTAGCCTG | SEQ ID NO: 1307 |
| BM734516.V1.3_at | GCGCCGAAACGTCTGCATCAAGGTG | SEQ ID NO: 1308 |
| BM734516.V1.3_at | ATTCGGCACGAGTAGGATTGTCACA | SEQ ID NO: 1309 |
| BM734516.V1.3_at | AGTGGTATCTTACTCTGGCAGTTAC | SEQ ID NO: 1310 |
| BM734516.V1.3_at | TGGCAGTTACCAGACTACCTTAAAA | SEQ ID NO: 1311 |
| BM734516.V1.3_at | GTGAGCCTTCTGTGTATGATCTGTC | SEQ ID NO: 1312 |
| BM734516.V1.3_at | ATGATCTGTCTGTTCCTGTTTCAAA | SEQ ID NO: 1313 |
| BM734517.V1.3_at | AATTTTCTCCTAGTCTGTAGCTTTT | SEQ ID NO: 1314 |
| BM734517.V1.3_at | TGTAGCTTTTCTTTTCACGTGTTAA | SEQ ID NO: 1315 |
| BM734517.V1.3_at | GAAGCCCGATTTATCCATTTGTTCT | SEQ ID NO: 1316 |
| BM734517.V1.3_at | GACATGCCCTTGGTGTGGTATCTAA | SEQ ID NO: 1317 |
| BM734517.V1.3_at | GGATATCCATTTATTCTAGCACCAT | SEQ ID NO: 1318 |
| BM734517.V1.3_at | AAGGCTGTTTATTCTCCATTGCATT | SEQ ID NO: 1319 |
| BM734517.V1.3_at | CATTGCCTTTGCACCTTTGTACAAA | SEQ ID NO: 1320 |
| BM734517.V1.3_at | GTAGGCTTATTTCTGGACTCTGTTC | SEQ ID NO: 1321 |
| BM734517.V1.3_at | GTTCTGTTCCTTTTCTCTGTTTATA | SEQ ID NO: 1322 |
| BM734517.V1.3_at | AGACAGGTAGTGTTAGCCCTCCAAC | SEQ ID NO: 1323 |
| BM734517.V1.3_at | TGGCTATTCTAGGTCATTTGCATTT | SEQ ID NO: 1324 |
| BM734518.V1.3_at | AGCAACTGGCACAAGGGCTGGGACT | SEQ ID NO: 1325 |
| BM734518.V1.3_at | GGGACTGGACCTCAGGGTCTAACAA | SEQ ID NO: 1326 |
| BM734518.V1.3_at | TAACAAGTGTCCAGCTGAGGCCACC | SEQ ID NO: 1327 |
| BM734518.V1.3_at | CTGCCGCACATTTGAGTCCTACTTC | SEQ ID NO: 1328 |
| BM734518.V1.3_at | GCTGCCCTGTGTGAGGAACTCTGGA | SEQ ID NO: 1329 |
| BM734518.V1.3_at | GGAGTCACTCCTACAAGGTCAGCAA | SEQ ID NO: 1330 |
| BM734518.V1.3_at | AGGTCAGCAACTACCGCCGAGGGAG | SEQ ID NO: 1331 |
| BM734518.V1.3_at | TGCATCCAGATGTGGTTCGACCCGG | SEQ ID NO: 1332 |
| BM734518.V1.3_at | GAGGTTCTATGCCTTGGCCATGACT | SEQ ID NO: 1333 |
| BM734518.V1.3_at | AGCTTTGATGACCAGGCTAGGCTCA | SEQ ID NO: 1334 |
| BM734518.V1.3_at | TAGGCTCAGCTCAGCTCCTAAGCAT | SEQ ID NO: 1335 |
| BM734519.V1.3_at | AACCACAACGTGAATTTGCAACAGG | SEQ ID NO: 1336 |
| BM734519.V1.3_at | GAACCAAAACTTCTAAGGCCCTGCT | SEQ ID NO: 1337 |

TABLE 2-continued

| Probe Set Name | Probe Sequence | Sequence Identifier |
|---|---|---|
| BM734519.V1.3_at | GGGTCAGCCATTTTTAATGATCTCG | SEQ ID NO: 1338 |
| BM734519.V1.3_at | TGATCTCGGATGACCAAACCAGCCT | SEQ ID NO: 1339 |
| BM734519.V1.3_at | ATGACCAAACCAGCCTTCGGAGCGT | SEQ ID NO: 1340 |
| BM734519.V1.3_at | TCTGTCCTACTTCTGACTTTACTTG | SEQ ID NO: 1341 |
| BM734519.V1.3_at | CTGACTTTACTTGTGGTGTGACCAT | SEQ ID NO: 1342 |
| BM734519.V1.3_at | GTGTGACCATGTTCATTATAATCTC | SEQ ID NO: 1343 |
| BM734519.V1.3_at | CAATCTTATTCCGAGCATTCCAGTA | SEQ ID NO: 1344 |
| BN734519.V1.3_at | GAGCATTCCAGTAACTTTTTTGTGT | SEQ ID NO: 1345 |
| BM734519.V1.3_at | TTTGGCCTGTTTGATGTATGTGTGA | SEQ ID NO: 1346 |
| BM734526.V1.3_at | GTCTGGCCCGGTTCAAAAGCAACGT | SEQ ID NO: 1347 |
| BM734526.V1.3_at | AGGGTTTTGAGTACATCTTGGCCAA | SEQ ID NO: 1348 |
| BM734526.V1.3_at | TAAAAGTCAACTTCCAGTCCTCTCT | SEQ ID NO: 1349 |
| BM734526.V1.3_at | TTTTGGGCATCTACGGTGCACCAGG | SEQ ID NO: 1350 |
| BM734526.V1.3_at | GTTACCAACATCTGAGCCGAGTCTG | SEQ ID NO: 1351 |
| BM734526.V1.3_at | GAGTCTGCTTATTCTCACATTGGGC | SEQ ID NO: 1352 |
| BM734526.V1.3_at | AGGTGCAGTGACTTGCCCAGGGTCA | SEQ ID NO: 1353 |
| BM734526.V1.3_at | ACAGCGTGCGGGTGACATGGCATA | SEQ ID NO: 1354 |
| BM734526.V1.3_at | TAAATGCTAGACTGTACGCTCCACG | SEQ ID NO: 1355 |
| BM734526.V1.3_at | AGGGCAGGACCTGTGTTTTGTTGTC | SEQ ID NO: 1356 |
| BM734526.V1.3_at | TTGTTGTCCGATGTGTCCCAGGTAC | SEQ ID NO: 1357 |
| BM734529.V1.3_at | GAAGTGGAGTCTTTGCCTTTCCCAA | SEQ ID NO: 1358 |
| BM734529.V1.3_at | AGACTTTCAACAGCTCCCAAGATGT | SEQ ID NO: 1359 |
| BM734529.V1.3_at | AAGATGTTTCCCACTTACACACTGG | SEQ ID NO: 1360 |
| BM734529.V1.3_at | ATCACCTTCCACCTAGGCAGAGAAG | SEQ ID NO: 1361 |
| BM734529.V1.3_at | GAAGGGCAACTCCTAACAACCGGTG | SEQ ID NO: 1362 |
| BM734529.V1.3_at | ACAACCGGTGCACTGTGTAAACACT | SEQ ID NO: 1363 |
| BM734529.V1.3_at | TGGTGCAACAGCTAGTTCCGTGCCT | SEQ ID NO: 1364 |
| BM734529.V1.3_at | AATGGGTACCCATAGCCACTGGTGG | SEQ ID NO: 1365 |
| BM734529.V1.3_at | AGAGCATACGTCACACCAGGAACTG | SEQ ID NO: 1366 |
| BM734529.V1.3_at | AAGCATATTTCCTCCAGTTGGTTTC | SEQ ID NO: 1367 |
| BM734529.V1.3_at | GGCAGTACCACATCACATGCTATAC | SEQ ID NO: 1368 |
| BM734531.V1.3_at | GAGTCACCCAAGGAACTTATGCAGA | SEQ ID NO: 1369 |
| BM734531.V1.3_at | TTATGCAGATGCCATGTCCTCACTC | SEQ ID NO: 1370 |
| BM734531.V1.3_at | GGAGCCAGGTGTCTGCATTTGAACA | SEQ ID NO: 1371 |
| BM734531.V1.3_at | GTCCTGTGGCTTTTGTGTGTCTCTC | SEQ ID NO: 1372 |
| BM734531.V1.3_at | ACCACTTCATGTTCTCTACAGAGCT | SEQ ID NO: 1373 |
| BM734531.V1.3_at | GGCCTTGCTTGAGAGAGGTCCATCC | SEQ ID NO: 1374 |
| BM734531.V1.3_at | GGTCACTTAGCAGCGACTTCTTGGA | SEQ ID NO: 1375 |
| BM734531.V1.3_at | ACAGAGCTGTCCAGAGCCGAGGCTG | SEQ ID NO: 1376 |

TABLE 2-continued

| Probe Set Name | Probe Sequence | Sequence Identifier |
|---|---|---|
| BM734531.V1.3_at | CGTTGCCCGCTGTTGGTCATGACAA | SEQ ID NO: 1377 |
| BM734531.V1.3_at | AAACGAGTCCGAGGGCACAGCCAGG | SEQ ID NO: 1378 |
| BM734531.V1.3_at | GAGTCTCTGTCAGGATCCTTTTGAA | SEQ ID NO: 1379 |
| BM734533.V1.3_at | CTCGTGCCGTGTGCTGAGAGGCCCT | SEQ ID NO: 1380 |
| BM734533.V1.3_at | AGGCACAGCCCCTGGAATCCTGAGC | SEQ ID NO: 1381 |
| BM734533.V1.3_at | GGAATCCTGAGCTGCCATGGGCTAC | SEQ ID NO: 1382 |
| BM734533.V1.3_at | ATGGGCTACCCCAAGACGTCCAGAG | SEQ ID NO: 1383 |
| BM734533.V1.3_at | GCTACCCCAAGACGTCCAGAGAAGA | SEQ ID NO: 1384 |
| BM734533.V1.3_at | GACAATGAACGTTGGAAGATCCGAT | SEQ ID NO: 1385 |
| BM734533.V1.3_at | TTGGAAGATCCGATTTCACAGCACT | SEQ ID NO: 1386 |
| BM734533.V1.3_at | GAACAGGTGTGTCAGTGTGCTCCCA | SEQ ID NO: 1387 |
| BM734533.V1.3_at | CACGATGACGATGAGGAGGAAGAAC | SEQ ID NO: 1388 |
| BM734533.V1.3_at | GGAAGAACGTGCCACCTCAGGTCGA | SEQ ID NO: 1389 |
| BM734533.V1.3_at | ACGTGCCACCTCAGGTCGATTTAGG | SEQ ID NO: 1390 |
| BM734539.V1.3_at | GAGGCTGCCAGCACAGGGTGATCAC | SEQ ID NO: 1391 |
| BM734539.V1.3_at | ATCACAGCCCAAGCAGTGGAGGCCT | SEQ ID NO: 1392 |
| BM734539.V1.3_at | GACAGATACCTGTGAACCCATCAGC | SEQ ID NO: 1393 |
| BM734539.V1.3_at | CGGTCTTCGGCAGCGGCTTTTTCAG | SEQ ID NO: 1394 |
| BM734539.V1.3_at | GCTTTTTCAGCCGAGTGAGGACTCT | SEQ ID NO: 1395 |
| BM734539.V1.3_at | GAGGACTCTGGGTCCCACGCAGAGA | SEQ ID NO: 1396 |
| BM734539.V1.3_at | AAGACCGTGGCCTCCTGGGAAGGCA | SEQ ID NO: 1397 |
| BM734539.V1.3_at | ATCTAAGTTCCAGAGCAGTTGACCT | SEQ ID NO: 1398 |
| BM734539.V1.3_at | GCAGTTGACCTGATGGGACGCTCTC | SEQ ID NO: 1399 |
| BM734539.V1.3_at | TTTGGTCTTAAGTGGATCTCGGGCA | SEQ ID NO: 1400 |
| BM734539.V1.3_at | CTGGCGTTTGACTACGAGCAGGAAC | SEQ ID NO: 1401 |
| BM734540.V1.3_at | GAAAGCACAGACTCTATATCCCTCA | SEQ ID NO: 1402 |
| BM734540.V1.3_at | TATATCCCTCATCGCATGGATCGTA | SEQ ID NO: 1403 |
| BM734540.V1.3_at | TGAGCAAAGCGGACCTCAGCCGGAA | SEQ ID NO: 1404 |
| BM734540.V1.3_at | AGCTTGTGCAGCTCCTGAATGGGCG | SEQ ID NO: 1405 |
| BM734540.V1.3_at | AGAGTTTTTCACTACCAGTTCCTGT | SEQ ID NO: 1406 |
| BM734540.V1.3_at | AACTGTTGCTGGCTACTGGTTACAC | SEQ ID NO: 1407 |
| BM734540.V1.3_at | ATTCTTCATGTGCAGTGTCGACAGC | SEQ ID NO: 1408 |
| BM734540.V1.3_at | GCACAGATTCTGCATTCAGTGGCAA | SEQ ID NO: 1409 |
| BM734540.V1.3_at | TCTGGCTTCAGGAACTCGGGCATAA | SEQ ID NO: 1410 |
| BM734540.V1.3_at | AAAGACCATGTTGGCTGTCCGGAGC | SEQ ID NO: 1411 |
| BM734540.V1.3_at | TGTCCGGAGCACACATGGCTTAGAA | SEQ ID NO: 1412 |
| BM734541.V1.3_at | TGAACATGCTTCAGATCTCCACGTT | SEQ ID NO: 1413 |
| BM734541.V1.3_at | TCTCCACGTTGCTCTGTAACATTAT | SEQ ID NO: 1414 |

TABLE 2-continued

| Probe Set Name | Probe Sequence | Sequence Identifier |
| --- | --- | --- |
| BM734541.V1.3_at | TATTTGTTATCCCTGCTCTGCAATG | SEQ ID NO: 1415 |
| BM734541.V1.3_at | AATGTAGTTCCCTGTTAGACCCAAG | SEQ ID NO: 1416 |
| BM734541.V1.3_at | GTGACACATGGCTTTCACTTCACAT | SEQ ID NO: 1417 |
| BM734541.V1.3_at | ATGAGTGATGTCTGCCATGGGCACA | SEQ ID NO: 1418 |
| BM734541.V1.3_at | GTTGCAGATGTTTGGGATCCTCCCT | SEQ ID NO: 1419 |
| BM734541.V1.3_at | TGTGCCCTCAATATGCTGTGTGTGC | SEQ ID NO: 1420 |
| BM734541.V1.3_at | CTGTGTGTGCCCTTTGGATGAAACT | SEQ ID NO: 1421 |
| BM734541.V1.3_at | AAGAATGGAAGCCTCTGGGCCTTTC | SEQ ID NO: 1422 |
| BM734541.V1.3_at | GGTGTGGACAGACTTCTTTTCCTCA | SEQ ID NO: 1423 |
| BM734543.V1.3_at | GGCTTCTTCACGTAGAACCCGGGAG | SEQ ID NO: 1424 |
| BM734543.V1.3_at | ATTCAGAATCGAATCTCTTCTCCCT | SEQ ID NO: 1425 |
| BM734543.V1.3_at | CTTCCTGTTTTTCGGCTTTGTGAGA | SEQ ID NO: 1426 |
| BM734543.V1.3_at | GTTACCAACAAGACAGATCCTCGCT | SEQ ID NO: 1427 |
| BM734543.V1.3_at | GGGAATCTCAATACTCTTGTGGTCA | SEQ ID NO: 1428 |
| BM734543.V1.3_at | AAATCGTGGGTTGCTCTGTTCATAA | SEQ ID NO: 1429 |
| BM734543.V1.3_at | GCTTTGCCTTCGTTCAGTACGTTAA | SEQ ID NO: 1430 |
| BM734543.V1.3_at | AATGAGAGAAATGCCCGTGCTGCTG | SEQ ID NO: 1431 |
| BM734543.V1.3_at | GCAGAATGATCGCTGGCCAGGTTTT | SEQ ID NO: 1432 |
| BM734543.V1.3_at | TCAGCTCCTCTTTTGACTTGGACTA | SEQ ID NO: 1433 |
| BM734543.V1.3_at | GGATGTACAGTTACCCAGCACGTGT | SEQ ID NO: 1434 |
| BM734550.V1.3_at | TTTTGGTCCCTACTTCCAGCGTCAT | SEQ ID NO: 1435 |
| BM734550.V1.3_at | GTCATTCCTGCCTATCACTTTGGAG | SEQ ID NO: 1436 |
| BM734550.V1.3_at | CTGCCTATCACTTTGGAGCGTGTGG | SEQ ID NO: 1437 |
| BM734550.V1.3_at | CGAGATTTGGGCATTGCCAGCAGTT | SEQ ID NO: 1438 |
| BM734550.V1.3_at | CTTGTTTTTCCTGGGCAGCTTCCTT | SEQ ID NO: 1439 |
| BM734550.V1.3_at | GGCAGCTTCCTTGGGACAGAAACTT | SEQ ID NO: 1440 |
| BM734550.V1.3_at | CAAAGTTTTGGTGACTTGTGGCTA | SEQ ID NO: 1441 |
| BM734550.V1.3_at | TGAGTGTCCTTTTTCCCAGGGTGGG | SEQ ID NO: 1442 |
| BM734550.V1.3_at | ACAGCCGCCGTGCTGCAGCCTTGTG | SEQ ID NO: 1443 |
| BM734550.V1.3_at | GGTCCCCAGCTTCCCTGATGTAGGA | SEQ ID NO: 1444 |
| BM734550.V1.3_at | GCTTCCCTGATGTAGGAACCAGATT | SEQ ID NO: 1445 |
| BM734553.V1.3_at | GCAGCTTGGAAACGCACGGAAACCT | SEQ ID NO: 1446 |
| BM734553.V1.3_at | GGAAACCTATACTGAAGCCCAACAA | SEQ ID NO: 1447 |
| BM734553.V1.3_at | GCGAGGCGACCTGTATCACGGAGAT | SEQ ID NO: 1448 |
| BM734553.V1.3_at | TGTCGGTAATGATGGCTTGCTGGAA | SEQ ID NO: 1449 |
| BM734553.V1.3_at | GAATTCCGCGACGAAGCTTGCAGAA | SEQ ID NO: 1450 |
| BM734553.V1.3_at | AAAAGAGATCCAGGCCTTCTTCGAT | SEQ ID NO: 1451 |
| BM734553.V1.3_at | AGGCCTTCTTCCATTGTGCTTCGAA | SEQ ID NO: 1452 |
| BM734553.V1.3_at | GGAGAAGCCTTTTCAATGACGGGAC | SEQ ID NO: 1453 |

TABLE 2-continued

| Probe Set Name | Probe Sequence | Sequence Identifier |
|---|---|---|
| BM734553.V1.3_at | ATGACGGGACTGTAGCTTTTGAGAA | SEQ ID NO: 1454 |
| BM734553.V1.3_at | GCACTGTTATACTTTCTTTGCAGAG | SEQ ID NO: 1455 |
| BM734553.V1.3_at | TGTCCTTTGGAACCATTGTCTCTGT | SEQ ID NO: 1456 |
| BM734556.V1.3_at | GCACGAGTCAGTGTTCGCCATTTCA | SEQ ID NO: 1457 |
| BM734556.V1.3_at | GCCATTTCACGTTCGGTTCGGGAAG | SEQ ID NO: 1458 |
| BM734556.V1.3_at | GGAAGCTGGGAGTCCTGAGATCCAA | SEQ ID NO: 1459 |
| BM734556.V1.3_at | GATATAGAAATCAACGGCGACGCAG | SEQ ID NO: 1460 |
| BM734556.V1.3_at | GGCGACGCAGTGGATCTTCACATGA | SEQ ID NO: 1461 |
| BM734556.V1.3_at | AGAAGCTTTCTTTGTGGAGGAGACT | SEQ ID NO: 1462 |
| BM734556.V1.3_at | ATGAAAAGCTTCCTGCTTACCTTGC | SEQ ID NO: 1463 |
| BM734556.V1.3_at | ACCTCACCAATTCCTACTGAAGATC | SEQ ID NO: 1464 |
| BM734556.V1.3_at | TTAAAGATATTGACACCCGTTTGGT | SEQ ID NO: 1465 |
| BM734556.V1.3_at | GACCATCTCAGAGTTCAGACATCTC | SEQ ID NO: 1466 |
| BM734556.V1.3_at | GACATCTCACACATCTTAGACACGG | SEQ ID NO: 1467 |
| BM734557.V1.3_at | AAGCGTGCCCGCAAGGAGCTGCTCA | SEQ ID NO: 1468 |
| BM734557.V1.3_at | GGAGCTGCTCAACTTTTACGCCTGG | SEQ ID NO: 1469 |
| BM734557.V1.3_at | GGCAGCACCGCGAGACCAAGATGGA | SEQ ID NO: 1470 |
| BM734557.V1.3_at | AAGATGGAGCATCTCGCACAGCTGC | SEQ ID NO: 1471 |
| BM734557.V1.3_at | AGAGGATTGAACTGATGCGGGCCCA | SEQ ID NO: 1472 |
| BM734557.V1.3_at | AATGCTGGTCTCAGAGGCTGTGCCC | SEQ ID NO: 1473 |
| BM734557.V1.3_at | CGTCAAGCCGCCCAAAGATCTGAGG | SEQ ID NO: 1474 |
| BM734557.V1.3_at | GGGTGAAGGACCATGTCGCCCTCCA | SEQ ID NO: 1475 |
| BM734557.V1.3_at | ATTCTGGTGCTTCAGCAGTCCTGGG | SEQ ID NO: 1476 |
| BM734557.V1.3_at | AGCATGAGGACTTGGCCTTCAGGAA | SEQ ID NO: 1477 |
| BM734557.V1.3_at | TTCAGGAAGCCACTGGCCCAGGAGT | SEQ ID NO: 1478 |
| BM734560.V1.3_at | GTGTTTCCACTTTGGCTCTATCACA | SEQ ID NO: 1479 |
| BM734560.V1.3_at | TTATTTTGGTAAGTCCCTCTGCAG | SEQ ID NO: 1480 |
| BM734560.V1.3_at | AAGTCCCTCTGCAGTATCAGCTGGA | SEQ ID NO: 1481 |
| BM734560.V1.3_at | TGGAGTGTCCTTAGTACCACAGATT | SEQ ID NO: 1482 |
| BM734560.V1.3_at | GATTAGCCTAGCTCCCCATGAGAGA | SEQ ID NO: 1483 |
| BM734560.V1.3_at | AGGATCCACTAGAGGGCGGGTTACA | SEQ ID NO: 1484 |
| BM734560.V1.3_at | GAGTAGTTGTGTACGCACGCTCACA | SEQ ID NO: 1485 |
| BM734560.V1.3_at | GTGCAAACAACCCAGACGTCGTCAG | SEQ ID NO: 1486 |
| BM734560.V1.3_at | GTAAACCAAGTGTGCTGTGTCCATA | SEQ ID NO: 1487 |
| BM734560.V1.3_at | TTAACTGACACATGCCACAACGGGA | SEQ ID NO: 1488 |
| BM734560.V1.3_at | ACCAGGTAAACCACTAGGCTGCCGG | SEQ ID NO: 1489 |
| BM734564.V1.3_at | GCAATGGTTCTGTCATCGGATCTAA | SEQ ID NO: 1490 |
| BM734564.V1.3_at | ACTGAATAACCTTCCGGTGATCTCC | SEQ ID NO: 1491 |

TABLE 2-continued

| Probe Set Name | Probe Sequence | Sequence Identifier |
|---|---|---|
| BM734564.V1.3_at | GGTGATCTCCAACATGACGGCCACA | SEQ ID NO: 1492 |
| BM734564.V1.3_at | GACGGCCACATTAGACAGTTGCTCA | SEQ ID NO: 1493 |
| BM734564.V1.3_at | GTTGCTCAGCAGCAGATGGCAGTTT | SEQ ID NO: 1494 |
| BM734564.V1.3_at | GCAGTTTGGCTGCAGAAATGCCCAA | SEQ ID NO: 1495 |
| BM734564.V1.3_at | AACTAATTGCTATACCCACTGCAGC | SEQ ID NO: 1496 |
| BM734564.V1.3_at | TTACCAGCACCACCACAGGGACAAT | SEQ ID NO: 1497 |
| BM734564.V1.3_at | TCCCTCACGACGACTGTTGTTCAGG | SEQ ID NO: 1498 |
| BM734564.V1.3_at | GTTGTTCAGGCCACACCAAAGAGTC | SEQ ID NO: 1499 |
| BM734564.V1.3_at | GAGTCCTCCATTAAAACCCATTCAA | SEQ ID NO: 1500 |
| BM734567.V1.3_at | TTGGTGTGCCAATCAAAGTCCTACA | SEQ ID NO: 1501 |
| BM734567.V1.3_at | AGGCCGAGGGCCACATTGTGACATG | SEQ ID NO: 1502 |
| BM734567.V1.3_at | GGTGTATCGTGGGAAGCTCATTGAA | SEQ ID NO: 1503 |
| BM734567.V1.3_at | CGGAGGACAACATGAACTGCCAGAT | SEQ ID NO: 1504 |
| BM734567.V1.3_at | GAGCAGGTGTACATCCGCGGCAGCA | SEQ ID NO: 1505 |
| BM734567.V1.3_at | CAGCAAGATCCGCTTCCTGATTTTG | SEQ ID NO: 1506 |
| BM734567.V1.3_at | CCTGATTTTGCCTGACATGCTGAAA | SEQ ID NO: 1507 |
| BM734567.V1.3_at | AAAGCTGCTATTTTGAAGGCCCAAG | SEQ ID NO: 1508 |
| BM734567.V1.3_at | GAACAGAACTTTGCCTCTATTTTTT | SEQ ID NO: 1509 |
| BM734567.V1.3_at | GGGTGTGTGCTTATGTATATGTCCT | SEQ ID NO: 1510 |
| BM734567.V1.3_at | TATGTCCTAGGTTTTCTTTTGTCAA | SEQ ID NO: 1511 |
| BM734568.V1.3_at | TCGTGCTTCCTGATTGGCTGGAGGA | SEQ ID NO: 1512 |
| BM734568.V1.3_at | GGGCTTTGTCACCTGAGCAGTGAAT | SEQ ID NO: 1513 |
| BM734568.V1.3_at | GTGAATTAATGTTGGCATCTGCTCC | SEQ ID NO: 1514 |
| BM734568.V1.3_at | TTGGCATCTGCTCCAAACACTTGGA | SEQ ID NO: 1515 |
| BM734568.V1.3_at | AACACTTGGAGGAGAGCCACGATTT | SEQ ID NO: 1516 |
| BM734568.V1.3_at | GGAATCGTCCTCATGCAGCAGATTA | SEQ ID NO: 1517 |
| BM734568.V1.3_at | GCAGATTATGTTGGCTGATCCCCAT | SEQ ID NO: 1518 |
| BM734568.V1.3_at | ATCCGTGACTGCGTGATGTTTACTG | SEQ ID NO: 1519 |
| BM734568.V1.3_at | TGATGTTTACTGCACCTGGTGTGTA | SEQ ID NO: 1520 |
| BM734568.V1.3_at | GGGCACAGCGATGAACAAACAGACA | SEQ ID NO: 1521 |
| BM734568.V1.3_at | GGACTTACCCTGGTGGAGTTGACCT | SEQ ID NO: 1522 |
| BM734569.V1.3_at | AAAACTGTGCTGTCCTTGTGAGGTC | SEQ ID NO: 1523 |
| BM734569.V1.3_at | TGTGAGGTCACTGCCTGGACATGGC | SEQ ID NO: 1524 |
| BM734569.V1.3_at | GCTGCCTTCCTGTGCCCAGAAAGGA | SEQ ID NO: 1525 |
| BM734569.V1.3_at | GGTCTTCCTCTTAAGGCCAGTTGAA | SEQ ID NO: 1526 |
| BM734569.V1.3_at | GTTGAAGATGGTCCCTTGCAGTTTC | SEQ ID NO: 1527 |
| BM734569.V1.3_at | TTGCAGTTTCCCAAGTTAGGTTAGT | SEQ ID NO: 1528 |
| BM734569.V1.3_at | TAGTGATGTGAAATGCTCCTGCCCC | SEQ ID NO: 1529 |
| BM734569.V1.3_at | AGGCAATTGCTGGTTTTCTTCCCCA | SEQ ID NO: 1530 |

TABLE 2-continued

| Probe Set Name | Probe Sequence | Sequence Identifier |
|---|---|---|
| BM734569.V1.3_at | TCTTCCCCAATTCTTTTCCAATTAG | SEQ ID NO: 1531 |
| BM734569.V1.3_at | GCCTCACCCCTGTTGAGTTTTTAGT | SEQ ID NO: 1532 |
| BM734569.V1.3_at | AGTTTTTAGTCTCTTGTGCTGTGCC | SEQ ID NO: 1533 |
| BM734573.V1.3_at | TGTACACCCTCTCTGTGTCTGGAGA | SEQ ID NO: 1534 |
| BM734573.V1.3_at | GTGGGACCTACGGAACATGGGCTAC | SEQ ID NO: 1535 |
| BM734573.V1.3_at | GGGAGTCCAGCCTCAAGTACCAGAC | SEQ ID NO: 1536 |
| BM734573.V1.3_at | GGGCATTTCCGAACAAGCAGGGTTA | SEQ ID NO: 1537 |
| BM734573.V1.3_at | GTGGCAGTTGAGTACCTGGACCCAA | SEQ ID NO: 1538 |
| BM734573.V1.3_at | GAAGTACGCCTTCAAGTGTCACAGA | SEQ ID NO: 1539 |
| BM734573.V1.3_at | AGATTTACCCGGTCAATGCCATTTC | SEQ ID NO: 1540 |
| BM734573.V1.3_at | AAGCGACTGTGTCAGTTCCATCGGT | SEQ ID NO: 1541 |
| BM734573.V1.3_at | ATCGCATCACTTGCCTTCAGTAATG | SEQ ID NO: 1542 |
| BM734573.V1.3_at | GATGGGACTACACTTGCAATAGCAT | SEQ ID NO: 1543 |
| BM734573.V1.3_at | GGTATCTTCATTCGCCAAGTGACAG | SEQ ID NO: 1544 |
| BM734578.V1.3_at | ATGAGGTCAAAGCTGCTCGAGCCCG | SEQ ID NO: 1545 |
| BM734578.V1.3_at | GAGCCCCTTCACGTGATGGATATTG | SEQ ID NO: 1546 |
| BM734578.V1.3_at | GCCCCGTCGCTCTGTGGAAATTGAA | SEQ ID NO: 1547 |
| BM734578.V1.3_at | AATTGAAGCCTTCTCACAGCATTGC | SEQ ID NO: 1548 |
| BM734578.V1.3_at | GATTTATGCATTTGGCCGTCGTCAA | SEQ ID NO: 1549 |
| BM734578.V1.3_at | TCAAGGGAACATTGCCCACTTCACA | SEQ ID NO: 1550 |
| BM734578.V1.3_at | GTACGTGGCAACTGAAGCTTTCTTG | SEQ ID NO: 1551 |
| BM734578.V1.3_at | CTTGTAGTTTGTTTCCCTGTTTGAG | SEQ ID NO: 1552 |
| BM734578.V1.3_at | GAGATATCTGACCTTAGCTTTTCCC | SEQ ID NO: 1553 |
| BM734578.V1.3_at | TGACTTTATTGTTTATCCCCTTCAC | SEQ ID NO: 1554 |
| BM734578.V1.3_at | GTAGCCATGGCAGCTTTTTGCAGTG | SEQ ID NO: 1555 |
| BM734583.V1.3_at | GCACAAAATAACCAAGAACATCCTC | SEQ ID NO: 1556 |
| BM734583.V1.3_at | AGAACATCCTCTTTTTTGGCAGATT | SEQ ID NO: 1557 |
| BM734583.V1.3_at | TTTGGCAGATTTGCCTCACCCTAAA | SEQ ID NO: 1558 |
| BM734583.V1.3_at | ATTTGCCTCACCCTAAAATTGAAAG | SEQ ID NO: 1559 |
| BM734583.V1.3_at | AATTGAAAGGTTCTGTTTCTGCACA | SEQ ID NO: 1560 |
| BM734583.V1.3_at | GGTTCTGTTTCTGCACAGGATTTTG | SEQ ID NO: 1561 |
| BM734583.V1.3_at | CACAGGATTTTGTAATATGAGCTAT | SEQ ID NO: 1562 |
| BM734583.V1.3_at | TATGAGCTATAAGCCTCAGATTTGC | SEQ ID NO: 1563 |
| BM734583.V1.3_at | TAAGCCTCAGATTTGCTCTAGTGCC | SEQ ID NO: 1564 |
| BM734583.V1.3_at | TCAGATTTGCTCTAGTGCCCAAAAT | SEQ ID NO: 1565 |
| BM734583.V1.3_at | CTAGTGCCCAAAATTTAGAGACTTT | SEQ ID NO: 1566 |
| BM734593.V1.3_at | TGACCTTGGAGAACCTCACTGCAGA | SEQ ID NO: 1567 |
| BM734593.V1.3_at | TGATCCCTTTTTCCAGGTTCAGGTG | SEQ ID NO: 1568 |

TABLE 2-continued

| Probe Set Name | Probe Sequence | Sequence Identifier |
|---|---|---|
| BM734593.V1.3_at | AGGTTCAGGTGTTGGTTTCCTCAGC | SEQ ID NO: 1569 |
| BM734593.V1.3_at | ACAAGAGCTCTACGTGGACACCTGG | SEQ ID NO: 1570 |
| BM734593.V1.3_at | GGACATTCCAGCCAACACCAAGGGT | SEQ ID NO: 1571 |
| BM734593.V1.3_at | TGCTCCTCATATTCCTGAAGGTGCC | SEQ ID NO: 1572 |
| BM734593.V1.3_at | TCAGTGCCGTCCTCTGGGTGAACAG | SEQ ID NO: 1573 |
| BM734593.V1.3_at | AGAGCCAGCCTGACCAAGAAAACCT | SEQ ID NO: 1574 |
| BM734593.V1.3_at | CTCGCCCATCAATATCTTGTGCAGA | SEQ ID NO: 1575 |
| BM734593.V1.3_at | AGACCCTGAATCTGATATCCCTTTT | SEQ ID NO: 1576 |
| BM734593.V1.3_at | TTTTCACCCTATTGCCAGAGACTTT | SEQ ID NO: 1577 |
| BM734597.V1.3_at | GCTGCTATACATTCACCGGTAAGAA | SEQ ID NO: 1578 |
| BM734597.V1.3_at | AGAAGATCTCATCTCAGAGGCTGGG | SEQ ID NO: 1579 |
| BM734607.V1.3_at | AAGAGCATTGCGAGAGCGGGCACCA | SEQ ID NO: 1580 |
| BM734607.V1.3_at | CAATGTGTCAGCAGAGCGTGCCGAA | SEQ ID NO: 1581 |
| BM734607.V1.3_at | AAGCACTCGCTGGAGCTTCATGAGG | SEQ ID NO: 1582 |
| BM734607.V1.3_at | TTGCGTGTCAGTTCTGTGAGCTGGC | SEQ ID NO: 1583 |
| BM734607.V1.3_at | TGGCCGTGCGCCTCAGTAAGGCAGA | SEQ ID NO: 1584 |
| BM734607.V1.3_at | GAGATCCATGAGTACCACTGTGGCA | SEQ ID NO: 1585 |
| BM734607.V1.3_at | TGGCCCAGCACAAGGACGTGTGTCA | SEQ ID NO: 1586 |
| BM734607.V1.3_at | GAGATAAGTATTCCCACCACGTGGA | SEQ ID NO: 1587 |
| BM734607.V1.3_at | TAAATGTCGCACAGTCTCAGAGTCT | SEQ ID NO: 1588 |
| BM734607.V1.3_at | GGAAAGCCAAGAATTCCTCCTCCAT | SEQ ID NO: 1589 |
| BM734607.V1.3_at | TCCAAGCCAGGCTGCTGAAGATCAA | SEQ ID NO: 1590 |
| BM734613.V1.3_at | CCAGTGGATTGGTCACCTGCTAGAC | SEQ ID NO: 1591 |
| BM734613.V1.3_at | GGCAGAATCCCCTTACTAAGCAGAT | SEQ ID NO: 1592 |
| BM734613.V1.3_at | GATTTGCTGAATCCGCTTTGTATCA | SEQ ID NO: 1593 |
| BM734613.V1.3_at | CTGCTTTGTACATAGGGCGTGATCC | SEQ ID NO: 1594 |
| BM734613.V1.3_at | CTGTGCCAGGAAGCCATTGCTCAGT | SEQ ID NO: 1595 |
| BM734613.V1.3_at | ATTGCTCAGTTCTACCTTTGTTTTT | SEQ ID NO: 1596 |
| BM734613.V1.3_at | TGTACTGCTCAGAATGTGTCCCTCT | SEQ ID NO: 1597 |
| BM734613.V1.3_at | ATTGGTTTAATGGTGACGCCTCCTG | SEQ ID NO: 1598 |
| BM734613.V1.3_at | GATCTGGTCACCTGTGCATTTGTGA | SEQ ID NO: 1599 |
| BM734613.V1.3_at | GAATTAGGCAGATCACCGTCTCTTG | SEQ ID NO: 1600 |
| BM734613.V1.3_at | GTCTCTTGTCTACCCAGTTTAACAA | SEQ ID NO: 1601 |
| BM734661.V1.3_at | GACGCAGACATGCAGATCTTTGTGA | SEQ ID NO: 1602 |
| BM734661.V1.3_at | ATCTTTGTGAAGACCCTGACGGGCA | SEQ ID NO: 1603 |
| BM734661.V1.3_at | GGTTGAGCCCAGTGACACCATTGAG | SEQ ID NO: 1604 |
| BM734661.V1.3_at | AGCAGCGTTTGATTTTTGCCGGCAA | SEQ ID NO: 1605 |
| BM734661.V1.3_at | TTTTGCCGGCAAACAGCTGGAGGAC | SEQ ID NO: 1606 |
| BM734661.V1.3_at | CACTCTCTCAGACTACAATATCCAG | SEQ ID NO: 1607 |

TABLE 2-continued

| Probe Set Name | Probe Sequence | Sequence Identifier |
| --- | --- | --- |
| BM734661.V1.3_at | ATTTGCCGCAAGTGTTATGCTCGCC | SEQ ID NO: 1608 |
| BM734661.V1.3_at | TCGTGCTGTCAACTGCCGCAAGAAG | SEQ ID NO: 1609 |
| BM734661.V1.3_at | GCAAGAAGAAGTGCGGCCACACCAA | SEQ ID NO: 1610 |
| BM734661.V1.3_at | AACCTGCGCCCCAAGAAGAAGGTCA | SEQ ID NO: 1611 |
| BM734661.V1.3_at | GAAGGTCAAATAAGGCCCCTCCTCT | SEQ ID NO: 1612 |
| BM734719.V1.3_at | GAAGCTTCTTCCCACCTAGAAAGAA | SEQ ID NO: 1613 |
| BM734719.V1.3_at | AGAAGTCCTCTCTGAGACTCAAGGG | SEQ ID NO: 1614 |
| BM734719.V1.3_at | AAGGGCTAAGGCAAGGTCTTCCAGA | SEQ ID NO: 1615 |
| BM734719.V1.3_at | ACGCCAATGGGTCAAACTAACTCTG | SEQ ID NO: 1616 |
| BM734719.V1.3_at | TTTCCACTGTCGTCAGAGCCAACAA | SEQ ID NO: 1617 |
| BM734719.V1.3_at | CAAGAAATGACAGCCTCCAAGCCTT | SEQ ID NO: 1618 |
| BM734719.V1.3_at | AAGCCTTCCTAAAAGCACACTTGCC | SEQ ID NO: 1619 |
| BM734719.V1.3_at | GGTGACAACGCTGGCTGCTGAAAGC | SEQ ID NO: 1620 |
| BM734719.V1.3_at | AAAGCCCATGAGCTGCTTCTTTGTT | SEQ ID NO: 1621 |
| BM734719.V1.3_at | TTCTTTGTTCTCTGTCACGGGACAA | SEQ ID NO: 1622 |
| BM734719.V1.3_at | AAAAATCTCTCATCCTATTCTGCTT | SEQ ID NO: 1623 |
| BM734862.V1.3_at | AGCATTGTCATTCCTGTGGCGTGCG | SEQ ID NO: 1624 |
| BM734862.V1.3_at | TGGCGTGCGCACTCGTGACTAAGAG | SEQ ID NO: 1625 |
| BM734862.V1.3_at | CTCGTGACTAAGAGCCTGGTCCTTA | SEQ ID NO: 1626 |
| BM734862.V1.3_at | TTACTGTCCTGTTTGCTGTCACACA | SEQ ID NO: 1627 |
| BM734862.V1.3_at | GAAGTCATTTGGATCCTAGGCCCAT | SEQ ID NO: 1628 |
| BM734862.V1.3_at | ATGAGGATGACCTCTGATCTCCATC | SEQ ID NO: 1629 |
| BM734862.V1.3_at | ATCTACATCCATCTGGCAGTTGTGC | SEQ ID NO: 1630 |
| BM734862.V1.3_at | GGCAGCGACATGAGTTGGATCCGTT | SEQ ID NO: 1631 |
| BM734862.V1.3_at | ACAAAGGTTATTTCTGAGGCTCAGG | SEQ ID NO: 1632 |
| BM734862.V1.3_at | CCCTCATTTCACTGATGACCGTGGG | SEQ ID NO: 1633 |
| BM734900.V1.3_at | GCTGGATTCCGCCTTTGAGGAGCCA | SEQ ID NO: 1634 |
| BM734900.V1.3_at | GAGGAGCCACTCACCAAGAAGATTT | SEQ ID NO: 1635 |
| BM734900.V1.3_at | GAAGATTTCTTCTTCTCTGGGCGC | SEQ ID NO: 1636 |
| BM734900.V1.3_at | GTGTACACAGGCAAGTCGGCGCTAG | SEQ ID NO: 1637 |
| BM734900.V1.3_at | TAGGCCCGAGGCGTCTGGACAAGCT | SEQ ID NO: 1638 |
| BM734900.V1.3_at | GTGTCAGCCCGGTGGACCAGATGTT | SEQ ID NO: 1639 |
| BM734900.V1.3_at | ACGACGTCTTCCAGTACCGAGAGAA | SEQ ID NO: 1640 |
| BM734900.V1.3_at | ACTGGCGCGTGAGTTCCCGGAATGA | SEQ ID NO: 1641 |
| BM734900.V1.3_at | AAGTGGGCTACGTGAGCTTCGACCT | SEQ ID NO: 1642 |
| BM734900.V1.3_at | GAAGGAGCCAGTTTGCCGGTTTCAA | SEQ ID NO: 1643 |
| BM734900.V1.3_at | GGTTTCAAACTGGTGGGTCTGTTCT | SEQ ID NO: 1644 |
| BM735031.V1.3_at | ACTGAGCTTTTGTAAGTCCCGACAC | SEQ ID NO: 1645 |

TABLE 2-continued

| Probe Set Name | Probe Sequence | Sequence Identifier |
| --- | --- | --- |
| BM735031.V1.3_at | AGCGGTCTGGAAGTGCTGTCATCAC | SEQ ID NO: 1646 |
| BM735031.V1.3_at | ATCATAGCTGCCATAGAGTTACTGT | SEQ ID NO: 1647 |
| BM735031.V1.3_at | GAGTTACTGTTTCTCCGTACATAGA | SEQ ID NO: 1648 |
| BM735031.V1.3_at | AGAGGACAGTGCTTCTGACTGGAAT | SEQ ID NO: 1649 |
| BM735031.V1.3_at | GTTAGCATTCACTTTCAACGGGAGA | SEQ ID NO: 1650 |
| BM735031.V1.3_at | TGTGGTCAAATGTTCTCTAGGTCAA | SEQ ID NO: 1651 |
| BM735031.V1.3_at | TAGGTCAACCTTACATAGCATACTT | SEQ ID NO: 1652 |
| BM735031.V1.3_at | AGCAAAATTGGAGCTTCTGAGCCCA | SEQ ID NO: 1653 |
| BM735031.V1.3_at | TGAGCCCAAATCACTGTCACTGTTT | SEQ ID NO: 1654 |
| BM735031.V1.3_at | TCTTTCTTTCAAACTGTGCTGCATG | SEQ ID NO: 1655 |
| BM735054.V1.3_at | GCTGGACTTCCATCACTGGGTGAGA | SEQ ID NO: 1656 |
| BM735054.V1.3_at | GTGAGAGGCTCACCCTGTCATCCAA | SEQ ID NO: 1657 |
| BM735054.V1.3_at | GGGACACTGAATGGCTTCAACCTAC | SEQ ID NO: 1658 |
| BM735054.V1.3_at | AATGGCTTCAACCTACTGGGTGCGC | SEQ ID NO: 1659 |
| BM735054.V1.3_at | AGCCAAGGCTACTGCAGCTGTGGTT | SEQ ID NO: 1660 |
| BM735054.V1.3_at | GTCCTTAGCGGCCAAGATGATGTCC | SEQ ID NO: 1661 |
| BM735054.V1.3_at | AAGATGATGTCCACGGCCGCCATTG | SEQ ID NO: 1662 |
| BM735054.V1.3_at | GGTGGCCACTCTACAGTCCGTGGGA | SEQ ID NO: 1663 |
| BM735054.V1.3_at | CAAAGTCATCCTGGGCTCCACTGGG | SEQ ID NO: 1664 |
| BM735054.V1.3_at | TCATGGCACCCCTGTAATAGCTCCT | SEQ ID NO: 1665 |
| BM735054.V1.3_at | TCAGCCCCGCACAGGAGAGGACTGG | SEQ ID NO: 1666 |
| BM735096.V1.3_at | AGAACAACATCATCACAGCCGAGGG | SEQ ID NO: 1667 |
| BM735096.V1.3_at | TGGGACGCTGCTGCTGTTCAGGAAA | SEQ ID NO: 1668 |
| BM735096.V1.3_at | GAAGTTCGGGCCAGACATCCAGGAT | SEQ ID NO: 1669 |
| BM735096.V1.3_at | GAGAATCTTTATGAGGGCCTGAACC | SEQ ID NO: 1670 |
| BM735096.V1.3_at | AACCTCGATGACTGTTCCATGTACG | SEQ ID NO: 1671 |
| BM735096.V1.3_at | ACATCGGAGACGTCCAGCTGGAGAA | SEQ ID NO: 1672 |
| BM735096.V1.3_at | ATCTGCTGTGCTTCCAATTTGTGTC | SEQ ID NO: 1673 |
| BM735096.V1.3_at | TGGAACGCGGTCTTTTCACAATCTT | SEQ ID NO: 1674 |
| BM735096.V1.3_at | ACAATCTTTCCTGGGAGTGTCCTGA | SEQ ID NO: 1675 |
| BM735096.V1.3_at | GGGTAATGAGCCCTTAATCGCTGCC | SEQ ID NO: 1676 |
| EM735096.V1.3_at | GATTGTAGCAGCCTCGTTAGTGCCA | SEQ ID NO: 1677 |
| BM735170.V1.3_at | TCGTCCTCACTGTTTTTACCTTGAC | SEQ ID NO: 1678 |
| BM735170.V1.3_at | TTTTTACCTTGACTTCAACTGCCCA | SEQ ID NO: 1679 |
| BM735170.V1.3_at | GCTGGAGCTGATTACTGAACTCGTA | SEQ ID NO: 1680 |
| BM735170.V1.3_at | TCGTATTTAATCTCTATTGCCAGTG | SEQ ID NO: 1681 |
| BM735170.V1.3_at | TATTTTTCTGATTGGTTTCCCCTCT | SEQ ID NO: 1682 |
| BM735170.V1.3_at | TGGTTTCCCCTCTTATTGGAAGTAT | SEQ ID NO: 1683 |
| BM735170.V1.3_at | GGAATCATTTGAGGCTTTCAGGTTA | SEQ ID NO: 1684 |

TABLE 2-continued

| Probe Set Name | Probe Sequence | Sequence Identifier |
|---|---|---|
| BM735170.V1.3_at | TTAGCAAGAGCTATGGGCGTTACAT | SEQ ID NO: 1685 |
| BM735170.V1.3_at | GGCGTTACATGCTTGTTTTTTCCAA | SEQ ID NO: 1686 |
| BM735170.V1.3_at | GGGAGCTTTGGCATCTTTTTAGATT | SEQ ID NO: 1687 |
| BM735170.V1.3_at | ATCTCTATTTTCTTAATCCAGGGTA | SEQ ID NO: 1688 |
| BM735449.V1.3_at | GTAATATGATTTCCCTTTACTTCCT | SEQ ID NO: 1689 |
| BM735449.V1.3_at | TACCCTTCTGTTAAACTGCTGCTAC | SEQ ID NO: 1690 |
| BM735449.V1.3_at | GCTGCTACTGGAGTTCGCCTTTAAA | SEQ ID NO: 1691 |
| BM735449.V1.3_at | GATTTGAAGTCCTTGGCATCCTGAA | SEQ ID NO: 1692 |
| BM735449.V1.3_at | GTTATATGCCATGTGCTTGTTATGA | SEQ ID NO: 1693 |
| BM735449.V1.3_at | TATGGTATGCCAGGAGACATTCTCC | SEQ ID NO: 1694 |
| BM735449.V1.3_at | GAGACATTCTCCTGATTTTCATTAT | SEQ ID NO: 1695 |
| BM735449.V1.3_at | AATGCTGTTCTTCTTATCTTTTATA | SEQ ID NO: 1696 |
| BM735449.V1.3_at | ATCAATTTCCGTTGTTTCGCTTGTC | SEQ ID NO: 1697 |
| BM735449.V1.3_at | GGTCTACATTAATTTTCCCCAGTCT | SEQ ID NO: 1698 |
| BM735449.V1.3_at | TAATTTTCCCCAGTCTGCATTAGAA | SEQ ID NO: 1699 |
| BM780886.V1.3_at | AAGGACCTGTCCTGGCTGATTAGTT | SEQ ID NO: 1700 |
| BM780886.V1.3_at | CTGATTAGTTGAGGCTGGGACAGCT | SEQ ID NO: 1701 |
| BM780886.V1.3_at | GACAGCTGGAAGGATGACATGACAT | SEQ ID NO: 1702 |
| BM780886.V1.3_at | TCTACACAGCGCATTTTGGAGGACA | SEQ ID NO: 1703 |
| BM780886.V1.3_at | CCCACACTGGGAAACTCTGCTGGTT | SEQ ID NO: 1704 |
| BM780886.V1.3_at | AAACTCTGCTGGTTCCTGGACGAGG | SEQ ID NO: 1705 |
| BM780886.V1.3_at | TGACCGTGCCCTTCGAGAAGCATTC | SEQ ID NO: 1706 |
| BM780886.V1.3_at | GAAGCATTCGGCCTTGTAGCCAGCC | SEQ ID NO: 1707 |
| BM780886.V1.3_at | GAAGAAAGCCGTGGCTGGGCCTTCT | SEQ ID NO: 1708 |
| BM780886.V1.3_at | CGGCGTTTGGCTTCCTTTCAGAAGA | SEQ ID NO: 1709 |
| BM780886.V1.3_at | GGCTTCCTTTCAGAAGAGCTGCCAC | SEQ ID NO: 1710 |
| BM781127.V1.3_at | CAATATGGTCCATCGCGGAGCACGG | SEQ ID NO: 1711 |
| BM781127.V1.3_at | CAACCTGCAGTACCTTCAAGACGAG | SEQ ID NO: 1712 |
| BM781127.V1.3_at | CATAGGCTTTGTGCTAAGCGGCGCT | SEQ ID NO: 1713 |
| BM781127.V1.3_at | AAGCGGCGCTGGGAACTTCATGGAC | SEQ ID NO: 1714 |
| BM781127.V1.3_at | GTGGCTTTGCCTACGTGGAGATCAG | SEQ ID NO: 1715 |
| BM781127.V1.3_at | GATCAGCCCCAAAGAGATGACCGTC | SEQ ID NO: 1716 |
| BM781127.V1.3_at | ATGACCGTCACTTACATCGAAGCTT | SEQ ID NO: 1717 |
| BM781127.V1.3_at | AAGCTTCGGGCAAGTCCCTGTTCAA | SEQ ID NO: 1718 |
| BM781127.V1.3_at | TTCAAGACCAGGCTGCCCAGGAGAG | SEQ ID NO: 1719 |
| BM781127.V1.3_at | GAAAGCAGCATGGACACCGGCCAGA | SEQ ID NO: 1720 |
| BM781127.V1.3_at | GAGGGAAATTTTCTCCTGGATTCAG | SEQ ID NO: 1721 |
| BM781436.V1.3_at | GGCACGAGATCCAGTACCAGCTAGT | SEQ ID NO: 1722 |

TABLE 2-continued

| Probe Set Name | Probe Sequence | Sequence Identifier |
|---|---|---|
| BM781436.V1.3_at | GCTAGTGGACATCTCTCAGGACAAC | SEQ ID NO: 1723 |
| BM781436.V1.3_at | AGGACAACGCCCTGCGGGATGAGAT | SEQ ID NO: 1724 |
| BM781436.V1.3_at | GACTATGAGCTCTTCGTGGAGGCTG | SEQ ID NO: 1725 |
| BM781436.V1.3_at | GCAAAACACGCTGCAGGAGTTCCTG | SEQ ID NO: 1726 |
| BM781436.V1.3_at | GAGTTCCTGAAACTGGCCTAAGCCA | SEQ ID NO: 1727 |
| BM781436.V1.3_at | GTGACCAATTCCCTGTTATTCCTAA | SEQ ID NO: 1728 |
| BM781436.V1.3_at | TATTCCTAACCTTCTGGCCTTGGAG | SEQ ID NO: 1729 |
| BM781436.V1.3_at | TCCTTACCCACTAGTCTCAGAAATT | SEQ ID NO: 1730 |
| BM781436.V1.3_at | CTGACACTGGCTGATGGGCACCTAT | SEQ ID NO: 1731 |
| BM781436.V1.3_at | GGGCACCTATGTTGGTTCCATTAGC | SEQ ID NO: 1732 |
| Foe1268.V1.3_at | ATCGGAGCTCATGATGGGCGGCACC | SEQ ID NO: 1733 |
| Foe1268.V1.3_at | AACACGCTGGTGCTGCATAACACAT | SEQ ID NO: 1734 |
| Foe1268.V1.3_at | AACACATGTGAGGACTCTCTCCTGG | SEQ ID NO: 1735 |
| Foe1268.V1.3_at | CATGCTGGATCTGGTACTGCTGACA | SEQ ID NO: 1736 |
| Foe1268.V1.3_at | AGAACTGTGCCAGCGTGTGAGCTTC | SEQ ID NO: 1737 |
| Foe1268.V1.3_at | AGCGCAGCTGCATCGAGAACATCCT | SEQ ID NO: 1738 |
| Foe1268.V1.3_at | AGAACATCCTAAGGGCCTGCGTGGG | SEQ ID NO: 1739 |
| Foe1268.V1.3_at | AGAACCACATGCTTCTGGAGCACAA | SEQ ID NO: 1740 |
| Foe1268.V1.3_at | TGGAGCACAAGATGGAGCGCCCCTG | SEQ ID NO: 1741 |
| Foe1268.V1.3_at | CAACGGCTGTGTCGGTGATGCCAAT | SEQ ID NO: 1742 |
| Foe1268.V1.3_at | AATGGTCATACAAAGGCCGAGGCAC | SEQ ID NO: 1743 |
| GI1305528.V1.3_at | AAGGAGCGCAACGACACCTGTGACA | SEQ ID NO: 1744 |
| GI1305528.V1.3_at | AAGTTCCTGAAGGAGCGGCTTGCTC | SEQ ID NO: 1745 |
| GI1305528.V1.3_at | GTTAAATCGGGCTCTCTGTCTCAGC | SEQ ID NO: 1746 |
| GI1305528.V1.3_at | TAGTTACCCATTCACAGATACCCGA | SEQ ID NO: 1747 |
| GI1305528.V1.3_at | GTCTGTGCTTGTCCTTTAGTGGATA | SEQ ID NO: 1748 |
| GI1305528.V1.3_at | AAGCATTGAGACTAGAGCCCCGCCT | SEQ ID NO: 1749 |
| 0I1305528.V1.3_at | CCCGCCTTCATGTAGCATATGCTTT | SEQ ID NO: 1750 |
| GI1305528.V1.3_at | GAGCAGTGCCATTTTCTGGTTAGGA | SEQ ID NO: 1751 |
| GI1305528.V1.3_at | TCAGAGACCGATGTACGTGCAGCAT | SEQ ID NO: 1752 |
| GI1305528.V1.3_at | TTTTTTGTGTTGTCCTTTCGCATAC | SEQ ID NO: 1753 |
| GI1305528.V1.3_at | GCATACCCAGTGTTTTAGGCGTGTG | SEQ ID NO: 1754 |
| WBC004E01_V1.3_at | GGATGTATGCTCAAATGTTCTTTTA | SEQ ID NO: 1755 |
| WBC004E01_V1.3_at | GTTCTTTTAAATACCTCCTGATCAA | SEQ ID NO: 1756 |
| WBC004E01_V1.3_at | TTTACAACCTACTACAGACACCTGG | SEQ ID NO: 1757 |
| WBC004E01_V1.3_at | TCTGACCCTCCTTACTCTATTTTTT | SEQ ID NO: 1758 |
| WBC004E01_V1.3_at | TTGTGTTTTTGAAAGCCTGTCTCCT | SEQ ID NO: 1759 |
| WBC004E01_V1.3_at | AAGCCTGTCTCCTCTTGTGAGAATG | SEQ ID NO: 1760 |
| WBC004E01_V1.3_at | GAACATTTAGTCCTGTTTACGTTTG | SEQ ID NO: 1761 |

TABLE 2-continued

| Probe Set Name | Probe Sequence | Sequence Identifier |
|---|---|---|
| WBC004E01_V1.3_at | TTACGTTTGTACTCCAGCACCAAGA | SEQ ID NO: 1762 |
| WBC004E01_V1.3_at | CAGTACCTGAACATAGAATCCACGT | SEQ ID NO: 1763 |
| WBC004E01_V1.3_at | GGGAAGACTGTTTCAACCAAGATTT | SEQ ID NO: 1764 |
| WBC004E01_V1.3_at | GGTTGGTGACATGCACTTAGGGATA | SEQ ID NO: 1765 |
| WBC005G04_V1.3_at | GATCCAAAGATTGAGGTCCCTACCA | SEQ ID NO: 1766 |
| WBC005G04_V1.3_at | GAGGTCCCTACCAGAATTATCAAAA | SEQ ID NO: 1767 |
| WBC005G04_V1.3_at | TAATCTTCACAAACAAGCATCGGGA | SEQ ID NO: 1768 |
| WBC005G04_V1.3_at | TATGGGTTGTTTGTGTTACATCAGA | SEQ ID NO: 1769 |
| WBC005G04_V1.3_at | GATAAACTTCGACTCTTCTGCTTTC | SEQ ID NO: 1770 |
| WBC005G04_V1.3_at | TCGACTCTTCTGCTTTCAATTGAGA | SEQ ID NO: 1771 |
| WBC005G04_V1.3_at | AGAGGCTGAAACTGACATGTGGAAA | SEQ ID NO: 1772 |
| WBC005G04_V1.3_at | GTTTCATTCAGGTCATCAAGGCTAA | SEQ ID NO: 1773 |
| WBC005G04_V1.3_at | ATCTGAAGTGAAGAACCCTCCTCCA | SEQ ID NO: 1774 |
| WBC005G04_V1.3_at | AGAACCCTCCTCCAAATCAATTGGG | SEQ ID NO: 1775 |
| WBC005G04_V1.3_at | TTCAGCAGAAACAGCTCAGCACATT | SEQ ID NO: 1776 |
| WBC007A05_V1.3_at | GAAGGTCTACCAAGCTGTGCAGCAT | SEQ ID NO: 1777 |
| WBC007A05_V1.3_at | TGTGCAGCATAATCGAGCCACGGAA | SEQ ID NO: 1778 |
| WBC007A05_V1.3_at | TTATCTTGTGTTTTACTCCCTTTCA | SEQ ID NO: 1779 |
| WBC007A05_V1.3_at | TACTCCCTTTCATGTGATGTTGCTG | SEQ ID NO: 1780 |
| WBC007A05_V1.3_at | GATGTTGCTGATTCGCTGCATTCTA | SEQ ID NO: 1781 |
| WBC007A05_V1.3_at | GTTGCGGATCCAATTCTGTACTGTT | SEQ ID NO: 1782 |
| WBC007A05_V1.3_at | AAAATTCTGTACTGGGAGGCTCAAC | SEQ ID NO: 1783 |
| WBC007A05_V1.3_at | AAACGCATACCGTCTATGTCTACAA | SEQ ID NO: 1784 |
| WBC007A05_V1.3_at | GAAGACTGTGTTCCATCTGAGTGAA | SEQ ID NO: 1785 |
| WBC007A05_V1.3_at | GTGAATATTTTAATCCTCTCCAGTG | SEQ ID NO: 1786 |
| WBC007A05_V1.3_at | AAAACGCACTGTATTGCTCCTGACT | SEQ ID NO: 1787 |
| WBC007E09_V1.3_at | GGCTGTGTAAGTGACCTAATTAATA | SEQ ID NO: 1788 |
| WBC007E09_V1.3_at | AAGAGTATCGTCTTCCTACGCATAG | SEQ ID NO: 1789 |
| WBC007E09_V1.3_at | TAGGAAGCTTATTCTCTGGAGACAT | SEQ ID NO: 1790 |
| WBC007E09_V1.3_at | ATTGATACTCTCTGATTTAATCCAG | SEQ ID NO: 1791 |
| WBC007E09_V1.3_at | CCAGATCTGGGCTTATTTAACTAAA | SEQ ID NO: 1792 |
| WBC007E09_V1.3_at | ATATTCGACACTGCTGATTTTTTAA | SEQ ID NO: 1793 |
| WBC007E09_V1.3_at | GATGCACTGCACTTTTGATATGTTT | SEQ ID NO: 1794 |
| WBC007E09_V1.3_at | GCCAAATATTTAGGTCTGTCACTGA | SEQ ID NO: 1795 |
| WBC007E09_V1.3_at | TAGTTTTGTGACCTTATTCTCCCCT | SEQ ID NO: 1796 |
| WBC007E09_V1.3_at | CCCCACTTCCTCTGCAAAAAGATTT | SEQ ID NO: 1797 |
| WBC007E09_V1.3_at | AAACGTGGTTTGCAAGGCATTCTAT | SEQ ID NO: 1798 |
| WBC008B04_V1.3_at | AGATATCCTGCCCTGTGTTTTATTC | SEQ ID NO: 1799 |

TABLE 2-continued

| Probe Set Name | Probe Sequence | Sequence Identifier |
|---|---|---|
| WBC008B04_V1.3_at | GTTTTATTCCTGTGTGTTAACCTCA | SEQ ID NO: 1800 |
| WBC008B04_V1.3_at | AGCAAGAAAGTCTGCCCTTTGCCAT | SEQ ID NO: 1801 |
| WBC008B04_V1.3_at | GCGTGTGCGCACGTACATGCATGAG | SEQ ID NO: 1802 |
| WBC008B04_V1.3_at | TGTGGTTTCCAGCTTTGCTGACAGT | SEQ ID NO: 1803 |
| WBC008B04_V1.3_at | GAGAACTTAGCCTCCTAGTATCCAC | SEQ ID NO: 1804 |
| WBC008B04_V1.3_at | CAGTCTCAACTCTGGTTTCTCAAGA | SEQ ID NO: 1805 |
| WBC008B04_V1.3_at | AAGATCTGTCACGTTGGCCTACTAA | SEQ ID NO: 1806 |
| WBC008B04_V1.3_at | GTTGGCCTACTAACTTGACGTCTTC | SEQ ID NO: 1807 |
| WBC008B04_V1.3_at | GATCGCCCAGCGTTTTTAGATTGTA | SEQ ID NO: 1808 |
| WBC008B04_V1.3_at | TTATCTCTTGCTTTGTTACTTTGGG | SEQ ID NO: 1809 |
| WBC009D04_V1.3_at | GCACCTCGAGTATCAGTTCATTCAT | SEQ ID NO: 1810 |
| WBC009D04_V1.3_at | ATTGTGCTGTTACCATGACTCACGC | SEQ ID NO: 1811 |
| WBC009D04_V1.3_at | TGACTCACGCTCTTTGTTGACAGTT | SEQ ID NO: 1812 |
| WBC009D04_V1.3_at | AGGAGCCTGAGAATCTTGGTCCCTC | SEQ ID NO: 1813 |
| WBC009D04_V1.3_at | CTCCAACCTATGTGGCCCAAGTAAA | SEQ ID NO: 1814 |
| WBC009D04_V1.3_at | AACCAACTCCATTTGTTGCTCTGAA | SEQ ID NO: 1815 |
| WBC009D04_V1.3_at | TCTCCAGGGTTTTCTACCTTTGACA | SEQ ID NO: 1816 |
| WBC009D04_V1.3_at | GAGAGATTTGCCCTGTGTTATCCTG | SEQ ID NO: 1817 |
| WBC009D04_V1.3_at | GTCATTAGGACAGCTTCCTTCTTCA | SEQ ID NO: 1818 |
| WBC009D04_V1.3_at | GCACAGCTTCCTTAGCATTTAGCAT | SEQ ID NO: 1819 |
| WBC009D04_V1.3_at | TTTTTAGTTCTCCTGCTTTTGCAAT | SEQ ID NO: 1820 |
| WBC010B02_V1.3_at | GACAGCTGCTATGTACTACTTGAAG | SEQ ID NO: 1821 |
| WBC010B02_V1.3_at | GAGATGTTCTTCTCACAATGCCAGC | SEQ ID NO: 1822 |
| WBC010B02_V1.3_at | AATGCCAGCCTGTTGAAGATTAAGA | SEQ ID NO: 1823 |
| WBC010B02_V1.3_at | GAATCATTGGCTGGGATTATCTCCC | SEQ ID NO: 1824 |
| WBC010B02_V1.3_at | TGACACACCCTACAAGCTCTTGGAT | SEQ ID NO: 1825 |
| WBC010B02_V1.3_at | GGATGAGACAATTAGCTCCTCTGAT | SEQ ID NO: 1828 |
| WBC010B02_V1.3_at | CAATTAGCTCCTCTGATTGGTTCAG | SEQ ID NO: 1827 |
| WBC010B02_V1.3_at | CTGTCTGTGAGAAGTTGGCTAATCC | SEQ ID NO: 1828 |
| WBC010B02_V1.3_at | GTAGTCAGTGCATTATTTTGCCTCA | SEQ ID NO: 1829 |
| WBC010B02_V1.3_at | ATTTTGCCTCAGCTATTATCCTGCA | SEQ ID NO: 1830 |
| WBC010B02_V1.3_at | GAGGGCATACATCTTGTGGACGATA | SEQ ID NO: 1831 |
| WBC010C05_V1.3_at | TGGTCACAGCCTCCATAAAACTGGT | SEQ ID NO: 1832 |
| WBC010C05_V1.3_at | AACTGGTAGGTTTTGCTCAACATAC | SEQ ID NO: 1833 |
| WBC010C05_V1.3_at | TATTTGTGAGCAATGGCCTCGCCTA | SEQ ID NO: 1834 |
| WBC010C05_V1.3_at | TCGCCTACGTGTTAGCACATGTCGA | SEQ ID NO: 1835 |
| WBC010C05_V1.3_at | GGGTACTTCGATACACATGGCTAAA | SEQ ID NO: 1836 |
| WBC010C05_V1.3_at | AACACTTTTGTATGTCTTTCTGAAA | SEQ ID NO: 1837 |
| WBC010C05_V1.3_at | GAAGTAAAATGTCAGCCTCTCTCCT | SEQ ID NO: 1838 |

TABLE 2-continued

| Probe Set Name | Probe Sequence | Sequence Identifier |
|---|---|---|
| WBC010C05_V1.3_at | GCTGCTGGCTTTTAACTTCTTTGTA | SEQ ID NO: 1839 |
| WBC010C05_V1.3_at | GGCTATTTTATCGTTTTCTCATTGT | SEQ ID NO: 1840 |
| WBC010C05_V1.3_at | TAATGAGTAACTTCTCCCACTGTGT | SEQ ID NO: 1841 |
| WBC010C05_V1.3_at | GGATCGTCTTTACTGTTTTACTCTC | SEQ ID NO: 1842 |
| WBC012F12_V1.3_at | TTGGTTTGTTTCTACTTTCCTGCTA | SEQ ID NO: 1843 |
| WBC012F12_V1.3_at | ATATTTCCATTTCTCTCGTGTGTAC | SEQ ID NO: 1844 |
| WBC012F12_V1.3_at | CTTCCTCCTAACTTTGCATATCAAA | SEQ ID NO: 1845 |
| WBC012F12_V1.3_at | GGAACTCAGATTCAGTGCTACTTCT | SEQ ID NO: 1846 |
| WBC012F12_V1.3_at | ACTTCTATAGTGTTCTGCCATCTCA | SEQ ID NO: 1847 |
| WBC012F12_V1.3_at | AGTACTCCCAGTGTTGAGTGCCTCA | SEQ ID NO: 1848 |
| WBC012F12_V1.3_at | GAGTGCCTCAGTATTGCGCTTACCA | SEQ ID NO: 1849 |
| WBC012F12_V1.3_at | TACCAGTTTGCCCTGGAGCTGTTAT | SEQ ID NO: 1850 |
| WBC012F12_V1.3_at | TTCTCCTCCTACTGTGAATTTCTGG | SEQ ID NO: 1851 |
| WBC012F12_V1.3_at | AGGCTCTCATTTTTGTCTGTCCCAA | SEQ ID NO: 1852 |
| WBC012F12_V1.3_at | GGAACTCTGTAAGTCCTTTCGAACG | SEQ ID NO: 1853 |
| WBC013G08_V1.3_at | TAGAGGGTATCAATGCCTGGCCCAT | SEQ ID NO: 1854 |
| WBC013G08_V1.3_at | AATGCCTGGCCCATGTTACATAGAA | SEQ ID NO: 1855 |
| WBC013G08_V1.3_at | AGGCATGTACACTTTGATATAGCAG | SEQ ID NO: 1856 |
| WBC013G08_V1.3_at | GATATAGCAOGTTCACCTTAGGAAA | SEQ ID NO: 1857 |
| WBC013G08_V1.3_at | GTTCAGGCATTGCTTTAAACGATGA | SEQ ID NO: 1858 |
| WBC013G08_V1.3_at | TGAATTTAACACATCCATATACTGG | SEQ ID NO: 1859 |
| WBC013G08_V1.3_at | GGAAGACTATGTAGCCAGCAAGTAA | SEQ ID NO: 1860 |
| WBC013G08_V1.3_at | AGTAAATTGACAGTGGAGCTCCATT | SEQ ID NO: 1861 |
| WBC013G08_V1.3_at | CAGTGGAGCTCCATTTTACAAATGT | SEQ ID NO: 1862 |
| WBC013G08_V1.3_at | GTGCAGTCTTACATGTGTACACATA | SEQ ID NO: 1863 |
| WBC013G08_V1.3_at | GAATACGTCTGGAATGATCCATTAG | SEQ ID NO: 1864 |
| WBC016C12_V1.3_at | GTTCTCTTATGGTCCTACTTCTAAA | SEQ ID NO: 1865 |
| WBC016C12_V1.3_at | GCTTTATGTTAACTGTGAGGCCGCA | SEQ ID NO: 1866 |
| WBC016C12_V1.3_at | TGAGGCCGCATGTGTCCGTCACTGG | SEQ ID NO: 1867 |
| WBC016C12_V1.3_at | AGGCTGTCCCAGTGTTAATTGTATT | SEQ ID NO: 1868 |
| WBC016C12_V1.3_at | TTTACAGCAGGCCTACTAGACCAGC | SEQ ID NO: 1869 |
| WBC016C12_V1.3_at | TAGACCAGCAGGAAGCATCGCACAT | SEQ ID NO: 1870 |
| WBC016C12_V1.3_at | GCATCGCACATGTCACATTGCACAT | SEQ ID NO: 1871 |
| WBC016C12_V1.3_at | TTGCACATGGGAGCTCAGGTCCTGA | SEQ ID NO: 1872 |
| WBC016C12_V1.3_at | GTCCTGAAGTCAGGCTTCTGTCTGT | SEQ ID NO: 1873 |
| WBC016C12_V1.3_at | CTCTGCTGCCTGTGTTAATATTTCT | SEQ ID NO: 1874 |
| WBC016C12_V1.3_at | TAAACTCTTACCTACGATTACTGTG | SEQ ID NO: 1875 |
| WBC020C09_V1.3_at | AAAGCCATTCCAGCATGTGTGTCCT | SEQ ID NO: 1876 |

TABLE 2-continued

| Probe Set Name | Probe Sequence | Sequence Identifier |
|---|---|---|
| WBC020C09_V1.3_at | GTGCTGCCTCTAATCTAAGCTGGGT | SEQ ID NO: 1877 |
| WBC020C09_V1.3_at | AAGCGACCCTCGAGATTCTGATGAC | SEQ ID NO: 1878 |
| WBC020C09_V1.3_at | GATGACAGTTTTGCCACTGAGCCGT | SEQ ID NO: 1879 |
| WBC020C09_V1.3_at | GTGAGGCCTGGGACAAGTATTTTCT | SEQ ID NO: 1880 |
| WBC020C09_V1.3_at | AGTATTTTCTTCTCTGCTTCAGTTT | SEQ ID NO: 1881 |
| WBC020C09_V1.3_at | GTTTTCCTGAGTACAGTGTCACCAT | SEQ ID NO: 1882 |
| WBC020C09_V1.3_at | ATATCACACTAGAGACAGCCCCTTG | SEQ ID NO: 1883 |
| WBC020C09_V1.3_at | GACAGCCCCTTGTAAAGATCGTGTG | SEQ ID NO: 1884 |
| WBC020C09_V1.3_at | GAAGGGCTACATGATGCTCCTCTGC | SEQ ID NO: 1885 |
| WBC020C09_V1.3_at | ACACACTCTCCTGGGTGTAGCTGGA | SEQ ID NO: 1886 |
| WBC021A01_V1.3_at | TGTCCACGTCACTGAGTGCTGTGAG | SEQ ID NO: 1887 |
| WBC021A01_V1.3_at | GAGAGCCCAGAGGACACTCACGTAT | SEQ ID NO: 1888 |
| WBC021A01_V1.3_at | ACTCACGTATTCAOGTGCCCATTTT | SEQ ID NO: 1889 |
| WBC021A01_V1.3_at | AGATAAAAGCATGOCCTTTCCTGTC | SEQ ID NO: 1890 |
| WBC021A01_V1.3_at | GGTGCAGTTCCATCCATTCTGAATG | SEQ ID NO: 1891 |
| WBC021A01_V1.3_at | AAAAGTGGAGCCTGCCAGTGCTTTC | SEQ ID NO: 1892 |
| WBC021A01_V1.3_at | ATTTCACTGTCGTGGCTGGATAGCA | SEQ ID NO: 1893 |
| WBC021A01_V1.3_at | GAGGGCACCATGTAGTCCTGACGCA | SEQ ID NO: 1894 |
| WBC021A01_V1.3_at | GACGCAGTCCTGTGTGATTCCGTGA | SEQ ID NO: 1895 |
| WBC021A01_V1.3_at | TTTCTGTAACTGTCCTTCCAAACCA | SEQ ID NO: 1896 |
| WBC021A01_V1.3_at | TCTCACCAATGGTTGCTGTTACAGT | SEQ ID NO: 1897 |
| WBC022G05_V1.3_at | ACGTCAGTCTAATAGCACCTGTCAT | SEQ ID NO: 1898 |
| WBC022G05_V1.3_at | CACCTGTCATCTTTTCTGCTTAGAA | SEQ ID NO: 1899 |
| WBC022G05_V1.3_at | TTAGAACCGCTTATCTCGAAACGAT | SEQ ID NO: 1900 |
| WBC022G05_V1.3_at | TGAAATCATGTCTTGCACCCTTGAG | SEQ ID NO: 1901 |
| WBC022G05_V1.3_at | GTTTAGTCTCTGAATACCTTCTCCA | SEQ ID NO: 1902 |
| WBC022G05_V1.3_at | GGGACACATTCATTGAACCACTCAT | SEQ ID NO: 1903 |
| WBC022G05_V1.3_at | AACCACTCATGGCACATCTTAGAAG | SEQ ID NO: 1904 |
| WBC022G05_V1.3_at | GCACATTCATATCATAGGGAGCCGA | SEQ ID NO: 1905 |
| WBC022G05_V1.3_at | GGAGCCGACTGGTTCTCTTATTAGT | SEQ ID NO: 1906 |
| WBC022G05_V1.3_at | GTGTACTATCAGAGTGTGCTTTCGC | SEQ ID NO: 1907 |
| WBC022G05_V1.3_at | TGTGCTTTCGCTCATCTGGATATAC | SEQ ID NO: 1908 |
| WBC024D07_V1.3_at | AAGCAGCGGGACAAGGTGTCTTCTA | SEQ ID NO: 1909 |
| WBC024D07_V1.3_at | AATTCACTTGAGTCCTATGCATTCA | SEQ ID NO: 1910 |
| WBC024D07_V1.3_at | GGCTTGACAAGAACCAGACTGCAGA | SEQ ID NO: 1911 |
| WBC024D07_V1.3_at | GGAGAAAGTTTGCAACCCCATCATT | SEQ ID NO: 1912 |
| WBC024D07_V1.3_at | ATTACCAAGCTGTACCAGAGTGCAG | SEQ ID NO: 1913 |
| WBC024D07_V1.3_at | GGTTTCCCTGGTGGTGGAGCTCCTC | SEQ ID NO: 1914 |
| WBC024D07_V1.3_at | GGTGGATTAAGCCAACCCGAGCATA | SEQ ID NO: 1915 |

TABLE 2-continued

| Probe Set Name | Probe Sequence | Sequence Identifier |
|---|---|---|
| WBC024D07_V1.3_at | GCATAGATTTAGCATTGTTCCACAT | SEQ ID NO: 1916 |
| WBC024D07_V1.3_at | TTTGTAGCAAATTCCATGGCAGTTT | SEQ ID NO: 1917 |
| WBC024D07_V1.3_at | ATAACTGGGCATTCTTGATACTTGA | SEQ ID NO: 1918 |
| WBC024D07_V1.3_at | GCACTTTATAGGCACTGTATTGTAA | SEQ ID NO: 1919 |
| WBC024E03_V1.3_at | GCTAAAGGCAAATTCTCTCTCTTGA | SEQ ID NO: 1920 |
| WBC024E03_V1.3_at | GCTTTTCTGTTTGTTATGGGTTTAT | SEQ ID NO: 1921 |
| WBC024E03_V1.3_at | GAAGTACCTTTTCCAAATTCATGAG | SEQ ID NO: 1922 |
| WBC024E03_V1.3_at | CACAGCTGAATATATTCGGCCTTCA | SEQ ID NO: 1923 |
| WBC024E03_V1.3_at | TCGGCCTTCAACATGGTCACTAGTA | SEQ ID NO: 1924 |
| WBC024E03_V1.3_at | AATTGTCTTCACAGTTCTCTCAAGG | SEQ ID NO: 1925 |
| WBC024E03_V1.3_at | GTTCTCTCAAGGGAGCCAGGCTATT | SEQ ID NO: 1926 |
| WBC024E03_V1.3_at | TGACAACAGCTCTCTCAAGGCAAAT | SEQ ID NO: 1927 |
| WBC024E03_V1.3_at | CAAGGCAAATCCTCTTATTTTCCAA | SEQ ID NO: 1928 |
| WBC024E03_V1.3_at | GTGACCGACAAATCATTAACCAGAA | SEQ ID NO: 1929 |
| WBC024E03_V1.3_at | GAAAACTTGGCTGTGTAACTGCATT | SEQ ID NO: 1930 |
| WBC026C03_V1.3_at | GTAGTGGTATCTCATTGTAGTCTTA | SEQ ID NO: 1931 |
| WBC026C03_V1.3_at | GTAGTCTTAATTTGCGTTTCCTCAG | SEQ ID NO: 1932 |
| WBC026C03_V1.3_at | TATGTTCTGTCTTTTTATGTGCTTA | SEQ ID NO: 1933 |
| WBC026C03_V1.3_at | TATGTGCTTATTTGCCGCCCATGTA | SEQ ID NO: 1934 |
| WBC026C03_V1.3_at | ATGTATCTCTTTCTGCCTATTTTTG | SEQ ID NO: 1935 |
| WBC026C03_V1.3_at | GAGTACTAGATCTTTAGCAGCTATG | SEQ ID NO: 1936 |
| WBC026C03_V1.3_at | AAGTCCCAATCTATAGCTTGCCTTT | SEQ ID NO: 1937 |
| WBC026C03_V1.3_at | GCTTGCCTTTTCATGCTTTCAGGGA | SEQ ID NO: 1938 |
| WBC026C03_V1.3_at | GAAATCTTTGCCTAAACCAACATCA | SEQ ID NO: 1939 |
| WBC026C03_V1.3_at | GATTTTCTCTTGTGTTTTCTTCTAG | SEQ ID NO: 1940 |
| WBC026C03_V1.3_at | TATCCAATTGTTCCATACTGTTTGT | SEQ ID NO: 1941 |
| WBC028A02_V1.3_at | AAGGTGGCCACCTATTTTATTGTGA | SEQ ID NO: 1942 |
| WBC028A02_V1.3_at | TTTATTGTGAGCTCTTCCTAGGAAG | SEQ ID NO: 1943 |
| WBC028A02_V1.3_at | GGAAGGCTCCTATTTCAGCAGTTTG | SEQ ID NO: 1944 |
| WBC028A02_V1.3_at | CAGCAGTTTGGTCTGGCTAACTTTA | SEQ ID NO: 1945 |
| WBC028A02_V1.3_at | TAAGCTGACGTTGGCAGGCATTCAA | SEQ ID NO: 1946 |
| WBC028A02_V1.3_at | GGCATTCAAATTCATGTCTCCTTGG | SEQ ID NO: 1947 |
| WBC028A02_V1.3_at | GGGCCAATCTGTTCTATTTTGTGCC | SEQ ID NO: 1948 |
| WBC028A02_V1.3_at | AACTTAGCTGTCTCATCCCAAAAAT | SEQ ID NO: 1949 |
| WBC028A02_V1.3_at | GTGGTTAAGTTTAGTGCACTCCCCT | SEQ ID NO: 1950 |
| WBC028A02_V1.3_at | GTGACCCGGGTTCACAGATTTGGAT | SEQ ID NO: 1951 |
| WBC028A02_V1.3_at | GGATCCTGGATGCAGACCTAGGCCA | SEQ ID NO: 1952 |
| WBC028D07_V1.3_at | AAGACGTGGCTGATGCGCTTCTCCG | SEQ ID NO: 1953 |

TABLE 2-continued

| Probe Set Name | Probe Sequence | Sequence Identifier |
|---|---|---|
| WBC028D07_V1.3_at | GGACTGACCAGTCACTCTCAGAAAA | SEQ ID NO: 1954 |
| WBC028D07_V1.3_at | AAAGGCTGAATCTGCAGAAGCTGCA | SEQ ID NO: 1955 |
| WBC028D07_V1.3_at | ATAGGGCCCAGCTGCTGGCAGAGCA | SEQ ID NO: 1956 |
| WBC028D07_V1.3_at | GACTCTCGCTCTTAAACTTCAGGAA | SEQ ID NO: 1957 |
| WBC028D07_V1.3_at | GGAACAGGAACGACTTCTCAAGGAA | SEQ ID NO: 1958 |
| WBC028D07_V1.3_at | GCAGGAGATGCAGGCTATCCGAATG | SEQ ID NO: 1959 |
| WBC028D07_V1.3_at | AGCACCAGCTGGAGTATGTAACATA | SEQ ID NO: 1960 |
| WBC028D07_V1.3_at | ATGTAATTTCCTAACCATCTCTCCT | SEQ ID NO: 1961 |
| WBC028D07_V1.3_at | TCTCTCCTCCACAAGCAATAAGCTG | SEQ ID NO: 1962 |
| WBC028D07_V1.3_at | GATGCTTCCATTTTGTTGAGCTAT | SEQ ID NO: 1963 |
| WBC029A01_V1.3_at | ATGTGTTCATAAGTGCCAACCGACT | SEQ ID NO: 1964 |
| WBC029A01_V1.3_at | GCCAACCGACTAATTCATCAAACCA | SEQ ID NO: 1965 |
| WBC029A01_V1.3_at | AAACCAACTTGATACTTCAGACCTT | SEQ ID NO: 1966 |
| WBC029A01_V1.3_at | CAGACCTTCAAAACTGTGGCCTGAA | SEQ ID NO: 1967 |
| WBC029A01_V1.3_at | GAGATGTACTCTCAGTGGCAGTATT | SEQ ID NO: 1968 |
| WBC029A01_V1.3_at | GTATTGAACTGCCTTATCTGTAAAT | SEQ ID NO: 1969 |
| WBC029A01_V1.3_at | TGTATAAATTATCCGTCCCTCCTGA | SEQ ID NO: 1970 |
| WBC029A01_V1.3_at | GGGATTATTGCCATCTTACACCATA | SEQ ID NO: 1971 |
| WBC029A01_V1.3_at | GTAGCTTAATCATAATCTCACACTG | SEQ ID NO: 1972 |
| WBC029A01_V1.3_at | GAAGATTTTGCATCACTTTTGCTAT | SEQ ID NO: 1973 |
| WBC029A01_V1.3_at | GAATTTACGCCTTAATGTGTCATTA | SEQ ID NO: 1974 |
| WBC030G08_V1.3_at | GTGTTTAAAACACCGTCTCAAATCA | SEQ ID NO: 1975 |
| WBC030G08_V1.3_at | ACTTTGAATTAGTCTTTTGGCTCTA | SEQ ID NO: 1976 |
| WBC030G08_V1.3_at | TTGGCTCTAAATTTGCCACTTGAAT | SEQ ID NO: 1977 |
| WBC030G08_V1.3_at | GTTCACCTTATTCTATACCAGGGCT | SEQ ID NO: 1978 |
| WBC030G08_V1.3_at | TACCAGGGCTGGCTATTCAGATGAT | SEQ ID NO: 1979 |
| WBC030G08_V1.3_at | AATGCCATGTGCCAATACTTTTCAA | SEQ ID NO: 1980 |
| WBC030G08_V1.3_at | GCCAATACTTTTCAAGGTGCCTTTG | SEQ ID NO: 1981 |
| WBC030G08_V1.3_at | AACGCTCGAGAACTTAACACTTATT | SEQ ID NO: 1982 |
| WBC030G08_V1.3_at | ATGATTTGACTGTATCCTGTACCAA | SEQ ID NO: 1983 |
| WBC030G08_V1.3_at | GTATCCTGTACCAAGACTACTTACC | SEQ ID NO: 1984 |
| WBC030G08_V1.3_at | AGACTACTTACCTTGAATACACCAG | SEQ ID NO: 1985 |
| WBC031E09_V1.3_at | CCAACAGGTTGGTCTGATGGTCTGA | SEQ ID NO: 1986 |
| WBC031E09_V1.3_at | AATCTGATGGGCAGGCCTTGCGATT | SEQ ID NO: 1987 |
| WBC031E09_V1.3_at | GCATGCCTGCTTACTTAATGACTGA | SEQ ID NO: 1988 |
| WBC031E09_V1.3_at | AATGACTGAAACTGTGCACTTTTGT | SEQ ID NO: 1989 |
| WBC031E09_V1.3_at | GTGCACTTTTGTTCTGACACTGAAT | SEQ ID NO: 1990 |
| WBC031E09_V1.3_at | ATTTCCTGTTCCATAATAGTAGTTA | SEQ ID NO: 1991 |
| WEC031E09_V1.3_at | AAGTTTTAGCATGTCCTTAGAGGCA | SEQ ID NO: 1992 |

TABLE 2-continued

| Probe Set Name | Probe Sequence | Sequence Identifier |
|---|---|---|
| WBC031E09_V1.3_at | GGCAAGTATATGCTTCAACACCTAA | SEQ ID NO: 1993 |
| WBC031E09_V1.3_at | GGTACCTTCTTTGCTGAATGTGACA | SEQ ID NO: 1994 |
| WBC031E09_V1.3_at | GTGACAGAATCCATACCAGCTCATG | SEQ ID NO: 1995 |
| WBC031E09_V1.3_at | GTTTTCATCTTTACATATGGCACAT | SEQ ID NO: 1996 |
| WBC032C03_V1.3_at | AAGGATACCATTTTTGGCTCTCCCT | SEQ ID NO: 1997 |
| WBC032C03_V1.3_at | AGTACACAGTTTGACCCAGTGGCCA | SEQ ID NO: 1998 |
| WBC032C03_V1.3_at | AGTGGCCACTGGTTCACAGTACGCC | SEQ ID NO: 1999 |
| WBC032C03_V1.3_at | TGAAACAGTTTGTTCCCAGGCCGTG | SEQ ID NO: 2000 |
| WBC032C03_V1.3_at | AGAATCCTGGAGTGGCATGCTGACC | SEQ ID NO: 2001 |
| WBC032C03_V1.3_at | AATGGCTTGCTTCTGCAGAGGATGC | SEQ ID NO: 2002 |
| WBC032C03_V1.3_at | TGCCTCCAGCTTCTTGCTTAAGAAC | SEQ ID NO: 2003 |
| WBC032C03_V1.3_at | AATTTGTTGATTCTCTGCTAGGCCT | SEQ ID NO: 2004 |
| WBC032C03_V1.3_at | ATCACTTTCTTTTCTAGTTCCTTGG | SEQ ID NO: 2005 |
| WBC032C03_V1.3_at | AGTTCCTTGGTTTTCAGCTCAGGCT | SEQ ID NO: 2006 |
| WBC032C03_V1.3_at | AGGCTGCATTCTCTAACTCATACTG | SEQ ID NO: 2007 |
| WBC032G11_V1.3_at | GAAAATACACCCAAGCTCCAAGGCT | SEQ ID NO: 2008 |
| WBC032G11_V1.3_at | TAATGAGTCACCCATCCAGGAGATC | SEQ ID NO: 2009 |
| WBC032G11_V1.3_at | GGAGATCCCAACGTACTAGCAAGTA | SEQ ID NO: 2010 |
| WBC032G11_V1.3_at | AGACTGTCCTAAATCCTGATCAATA | SEQ ID NO: 2011 |
| WBC032G11_V1.3_at | ACATTGTGGGCCTCGAAGTGCTACA | SEQ ID NO: 2012 |
| WBC032G11_V1.3_at | AGGAGTGCACACATCACCTGGAGAT | SEQ ID NO: 2013 |
| WBC032G11_V1.3_at | GAACCTGAATCTGATCAAGCCTCTG | SEQ ID NO: 2014 |
| WBC032G11_V1.3_at | AAGCCTCTGGATCTTGCTTCCAATT | SEQ ID NO: 2015 |
| WBC032G11_V1.3_at | TGCTCCTAAGTAATTCCATGTATGG | SEQ ID NO: 2016 |
| WBC032G11_V1.3_at | GTTAATTATACTCCTCTCTTCTTTG | SEQ ID NO: 2017 |
| WBC032G11_V1.3_at | TCTCTTCTTTGGACTGTGCTTTTGA | SEQ ID NO: 2018 |
| WBC035E08_V1.3_at | GATACTTGGACATCTGCATCTTCAG | SEQ ID NO: 2019 |
| WBC035E08_V1.3_at | TCAGCTTACAAGATCTACAGTGCAT | SEQ ID NO: 2020 |
| WBC035E08_V1.3_at | GATTTCATTCTTTGTTAGCTCACTT | SEQ ID NO: 2021 |
| WBC035E08_V1.3_at | TGTCAACTCATTACTTTTTCCTGTG | SEQ ID NO: 2022 |
| WBC035E08_V1.3_at | GAATTAACTGTCTGTCTGCCTTGTC | SEQ ID NO: 2023 |
| WBC035E08_V1.3_at | CTGCCTTGTCTTAGGGTGTTCTGTA | SEQ ID NO: 2024 |
| WBC035E08_V1.3_at | GGTGTTCTGTAGATCGATTGCCGAT | SEQ ID NO: 2025 |
| WBC035E08_V1.3_at | TCGATTGCCGATTTCTTAAACCTGA | SEQ ID NO: 2026 |
| WBC035E08_V1.3_at | AAACCTGAAATGATCTTTACACTGT | SEQ ID NO: 2027 |
| WBC035E08_V1.3_at | TATTGACACCTTTTACAGATCTTAA | SEQ ID NO: 2028 |
| WBC035E08_V1.3_at | GATCTTAATGTAGCTTTTTCCATAT | SEQ ID NO: 2029 |
| WBC036C09_V1.3_at | GTTGATCCAGTTTGTCCTTTAGGTT | SEQ ID NO: 2030 |

TABLE 2-continued

| Probe Set Name | Probe Sequence | Sequence Identifier |
|---|---|---|
| WBC036C09_V1.3_at | GAATGTGGCCACAGATGCCTTGCTG | SEQ ID NO: 2031 |
| WBC036C09_V1.3_at | ATCTGTCCCTGAAGACTTGTGAGG | SEQ ID NO: 2032 |
| WBC036C09_V1.3_at | GTGAGGTCCTCTTTTGAAAGCCAAA | SEQ ID NO: 2033 |
| WBC036C09_V1.3_at | AGCTAGGACTTCACATTGCCATTCA | SEQ ID NO: 2034 |
| WBC036C09_V1.3_at | TTGCCATTCAAAACTCTTCTCTCTT | SEQ ID NO: 2035 |
| WBC036C09_V1.3_at | AGAATGATTGCCTTGCTGGTGTCCT | SEQ ID NO: 2036 |
| WBC036C09_V1.3_at | GAACGGCTTTGACCTGACGGTGCCT | SEQ ID NO: 2037 |
| WBC036C09_V1.3_at | AGGGAGCTTGTCTCTAGCGGGTTCA | SEQ ID NO: 2038 |
| WBC036C09_V1.3_at | GTGAACACTTTCCACTTTCTGACAC | SEQ ID NO: 2039 |
| WBC036C09_V1.3_at | TTCTGACACCTGATCCTGATGTATG | SEQ ID NO: 2040 |
| WBC041B04_V1.3_at | GTGTTAACCATGAAAGTACTCGAAG | SEQ ID NO: 2041 |
| WBC041B04_V1.3_at | AAGGGTACATTTCTCCTATGGCCGA | SEQ ID NO: 2042 |
| WBC041B04_V1.3_at | CTATGGCCGATTTCAGGAATTTCAA | SEQ ID NO: 2043 |
| WBC041B04_V1.3_at | GAGAATCCTTCAGTTCATTCACAAA | SEQ ID NO: 2044 |
| WBC041B04_V1.3_at | ATAAAGCCCTGGAGGGCCCTGAGGC | SEQ ID NO: 2045 |
| WBC041B04_V1.3_at | CCTGAGGCTCACTGCTGACTGAGAA | SEQ ID NO: 2046 |
| WBC041B04_V1.3_at | GACTGAGAACTCTGTGGAACATGAT | SEQ ID NO: 2047 |
| WBC041B04_V1.3_at | GGAACATGATCCTAGGCACTGAAGT | SEQ ID NO: 2048 |
| WBC041B04_V1.3_at | GGCACTGAAGTATCGACCACTTTCC | SEQ ID NO: 2049 |
| WBC041B04_V1.3_at | ACCACTTTCCTATTTCACCTGATTT | SEQ ID NO: 2050 |
| WBC041B04_V1.3_at | AGAATGGGACCATTTCTCTGTGAAT | SEQ ID NO: 2051 |
| WBC041C11_V1.3_at | AGAGGACTGCCTCGCAATACTTCGT | SEQ ID NO: 2052 |
| WBC041C11_V1.3_at | AATACTTCGTGCTGTTGCTGCTGAC | SEQ ID NO: 2053 |
| WBC041C11_V1.3_at | CTGCCCATGTCAGTGATCATCGTGG | SEQ ID NO: 2054 |
| WBC041C11_V1.3_at | AGCTGGACGCTGATGGTGGACCCCT | SEQ ID NO: 2055 |
| WBC041C11_V1.3_at | GCGTACACGCTCTGGGAAGGCATCT | SEQ ID NO: 2056 |
| WBC041C11_V1.3_at | AGGCATCTGCCCGTGACATAGTGCA | SEQ ID NO: 2057 |
| WBC041C11_V1.3_at | GACATAGTGCAGTTTGTGCCCTACC | SEQ ID NO: 2058 |
| WBC041C11_V1.3_at | AGAAGTACCTGCACAACTGGTCTCC | SEQ ID NO: 2059 |
| WBC041C11_V1.3_at | TCAGGCCTAGATTCCCTTGGAGGGT | SEQ ID NO: 2060 |
| WBC041C11_V1.3_at | AGGGTAAGCTGTGGCCAGTCCTCAG | SEQ ID NO: 2061 |
| WBC041C11_V1.3_at | TATACTTGTTCCTGCTATTTCTGCT | SEQ ID NO: 2062 |
| WBC048H02_V1.3_at | TACACTGTCCAGGATGAGAGCCACT | SEQ ID NO: 2063 |
| WBC048H02_V1.3_at | ATCATTGTCTCCTGTGGCTGGGACA | SEQ ID NO: 2064 |
| WBC048H02_V1.3_at | AGCTGAAGACCAATCACATCGGCCA | SEQ ID NO: 2065 |
| WBC048H02_V1.3_at | AGGCTACCTGAACACTGTCACTGTC | SEQ ID NO: 2066 |
| WBC048H02_V1.3_at | GATCCCTCTGTGCTTCTGGAGGCAA | SEQ ID NO: 2067 |
| WBC048H02_V1.3_at | GGCCAGGCCATGCTTTGGGATTTAA | SEQ ID NO: 2068 |
| WBC048H02_V1.3_at | GGCAAGCACCTTTACACACTAGATG | SEQ ID NO: 2069 |

TABLE 2-continued

| Probe Set Name | Probe Sequence | Sequence Identifier |
|---|---|---|
| WBC048H02_V1.3_at | GGGACATCATCAACGCCTTGTGCTT | SEQ ID NO: 2070 |
| WBC048H02_V1.3_at | AGAAGTTATCAGTACCAGCAGCAAG | SEQ ID NO: 2071 |
| WBC048H02_V1.3_at | AGACTCTGTTTGCTGGCTACACGGA | SEQ ID NO: 2072 |
| WBC048H02_V1.3_at | ATCGGCACCCGCTAGAAATACATGG | SEQ ID NO: 2073 |
| WBC285.gRSP.V1.3_at | GTTTCTGAAAATTCTCTTCTCTCCC | SEQ ID NO: 2074 |
| WBC285.gRSP.V1.3_at | CAACCCCTCAGCTTCTGGATATAAT | SEQ ID NO: 2075 |
| WBC285.gRSP.V1.3_at | GTGCATAATTGTGTATCCTCCTCAA | SEQ ID NO: 2076 |
| WBC285.gRSP.V1.3_at | GATGTTTACACTTTTCCAGACGAGA | SEQ ID NO: 2077 |
| WBC285.gRSP.V1.3_at | CAGATCGTGGATTTCTTTTCCTGTA | SEQ ID NO: 2078 |
| WBC285.gRSP.V1.3_at | AACAGATTCTTCTCACCGATGGTAG | SEQ ID NO: 2079 |
| WBC285.gRSP.V1.3_at | GATGGTCCCAATATGTCAGTTGCTG | SEQ ID NO: 2080 |
| WBC285.gRSP.V1.3_at | CTGGTGCAGTATTCTTTCCGTGATA | SEQ ID NO: 2081 |
| WBC285.gRSP.V1.3_at | ATTGGTGGTCTTGCCTGTATTTTCA | SEQ ID NO: 2082 |
| WBC285.gRSP.V1.3_at | CGGTGCGTTTTATCGGACTGATTCA | SEQ ID NO: 2083 |
| WBC285.gRSP.V1.3_at | ATAAAGGGTGCTGCTCTGAGGCTAG | SEQ ID NO: 2084 |
| WBC31.gFSP.V1.3_at | CAAGGCCCGTGATTTTTCTACCAGA | SEQ ID NO: 2085 |
| WBC31.gFSP.V1.3_at | GTGATTTTTCTACCAGACCTCACTG | SEQ ID NO: 2086 |
| WBC31.gFSP.V1.3_at | TACCAGACCTCACTGCTTTTGTGTT | SEQ ID NO: 2087 |
| WBC31.gFSP.V1.3_at | GACCTCACTGCTTTTGTGTTTAGGA | SEQ ID NO: 2088 |
| WBC31.gFSP.V1.3_at | CTCACTGCTTTTGTGTTTAGGAAAG | SEQ ID NO: 2089 |
| WBC31.gFSP.V1.3_at | GAAAGAGATCATATCTGCCCCAGCT | SEQ ID NO: 2090 |
| WBC31.gFSP.V1.3_at | AGAGATCATATCTGCCCCAGCTGGA | SEQ ID NO: 2091 |
| WBC31.gFSP.V1.3_at | TGCCCCAGCTGGATGTTTCGAGGAT | SEQ ID NO: 2092 |
| WBC31.gFSP.V1.3_at | AGCTGGATGTTTCGAGGATCCTCCT | SEQ ID NO: 2093 |
| WBC31.gFSP.V1.3_at | GGATGTTTCGAGGATCCTCCTCCCT | SEQ ID NO: 2094 |
| WBC31.gFSP.V1.3_at | CTCCTCCCTCTAGACATTGGAAGAA | SEQ ID NO: 2095 |
| WBC31.gFSP.V1.3_s_at | AATGCAGATTGAGAGCTCCCTGTCC | SEQ ID NO: 2096 |
| WBC31.gFSP.V1.3_s_at | TGTCCTCAGCCCTGAACTGGGAATT | SEQ ID NO: 2097 |
| WBC31.gFSP.V1.3_s_at | AGGAGACTTAGCTCTACACGCTCAA | SEQ ID NO: 2098 |
| WBC31.gFSP.V1.3_s_at | GTCTCTAGCCAACCAAACTCACAAG | SEQ ID NO: 2099 |
| WBC31.gFSP.V1.3_s_at | GTATAAGCCAGAGGCCCAGTGTTTC | SEQ ID NO: 2100 |
| WBC31.gFSP.V1.3_s_at | CAGTGTTTCCACCAGGCGTGGAGTA | SEQ ID NO: 2101 |
| WBC31.gFSP.V1.3_s_at | AGCTCTGGAGCTGTTAGTGCCTGGT | SEQ ID NO: 2102 |
| WBC31.gFSP.V1.3_s_at | TAGTGCCTGGTGTAACTCTTGCCTC | SEQ ID NO: 2103 |
| WBC31.gFSP.V1.3_s_at | TAGCCCTGTGATTCTGTGCAAGTTA | SEQ ID NO: 2104 |
| WBC31.gFSP.V1.3_s_at | TATTGATTGATCTCTCTAAGCCTCA | SEQ ID NO: 2105 |
| WBC31.gFSP.V1.3_s_at | TAAGCCTCAATTTCCTCATCTGTGA | SEQ ID NO: 2106 |
| WBC31.V1.3_s_at | AATGCAGATTGAGAGCTCCCTGTCC | SEQ ID NO: 2107 |

TABLE 2-continued

| Probe Set Name | Probe Sequence | Sequence Identifier |
|---|---|---|
| WBC31.V1.3_s_at | TGTCCTCAGCCCTGAACTGGGAATT | SEQ ID NO: 2108 |
| WBC31.V1.3_s_at | AGGAGACTTAGCTCTACACGCTCAA | SEQ ID NO: 2109 |
| WBC31.V1.3_s_at | GTCTCTAGCCAACCAAACTCACAAG | SEQ ID NO: 2110 |
| WBC31.V1.3_s_at | GTATAAGCCAGAGGCCCAGTGTTTC | SEQ ID NO: 2111 |
| WBC31.V1.3_s_at | CAGTGTTTCCACCAGGCGTGGAGTA | SEQ ID NO: 2112 |
| WBC31.V1.3_s_at | AGCTCTGGAGCTGTTAGTGCCTGGT | SEQ ID NO: 2113 |
| WBC31.V1.3_s_at | TAGTGCCTGGTGTAACTCTTGCCTC | SEQ ID NO: 2114 |
| WBC31.V1.3_s_at | TAGCCCTGTGATTCTGTGCAAGTTA | SEQ ID NO: 2115 |
| WBC31.V1.3_s_at | TATTGATTGATCTCTCTAAGCCTCA | SEQ ID NO: 2116 |
| WBC31.V1.3_s_at | TAAGCCTCAATTTCCTCATCTGTGA | SEQ ID NO: 2117 |
| WBC422.gRSP.V1.3_at | GGATGTGACTCCTGGTTATGTTCAG | SEQ ID NO: 2118 |
| WBC422.gRSP.V1.3_at | ATGTTCAGTGGACACTCTGCTTAGA | SEQ ID NO: 2119 |
| WBC422.gRSP.V1.3_at | AGATAGACGTGCTCCGGAAGATGGC | SEQ ID NO: 2120 |
| WBC422.gRSP.V1.3_at | GATGGCAGGAACTACCAGCATGGAA | SEQ ID NO: 2121 |
| WBC422.gRSP.V1.3_at | AAATGTGTCATAGGCTGGAGGGCTA | SEQ ID NO: 2122 |
| WBC422.gRSP.V1.3_at | AGACTTTTCCTTCTTGTTACACTCA | SEQ ID NO: 2123 |
| WBC422.gRSP.V1.3_at | GTTACACTCAACAAGGGCATGACTT | SEQ ID NO: 2124 |
| WBC422.gRSP.V1.3_at | GACTTAACTGTGTATTTTGTCTTTA | SEQ ID NO: 2125 |
| WBC422.gRSP.V1.3_at | TGTCTTTACAATCCTTTAGTGCCTG | SEQ ID NO: 2126 |
| WBC422.gRSP.V1.3_at | GGCTCATTTAATGTATGCTTGCTCA | SEQ ID NO: 2127 |
| WBC422.gRSP.V1.3_at | GTCTGTTTGCACATATTTTTAACCA | SEQ ID NO: 2128 |
| WBC44.V1.3_at | AAGATCTGATCTTCAAAGCAGCCAG | SEQ ID NO: 2129 |
| WBC44.V1.3_at | TGGTAGGCAGAATGATGCCCTCCCC | SEQ ID NO: 2130 |
| WBC44.V1.3_at | GATGTCCACACTTTAATCTCCTGAA | SEQ ID NO: 2131 |
| WBC44.V1.3_at | GATGTGATTAAGGTTACCCTGCAGA | SEQ ID NO: 2132 |
| WBC44.V1.3_at | CCAGGATTTTTCAGGTGGGCTCAAT | SEQ ID NO: 2133 |
| WBC44.V1.3_at | AAGAGAGAACCTTCCTAGCTGCTTC | SEQ ID NO: 2134 |
| WBC44.V1.3_at | ATATGATGCTCTGTGCTGGTTCTGA | SEQ ID NO: 2135 |
| WBC44.V1.3_at | GGATTGAAGCAAGCCTGCCAACACT | SEQ ID NO: 2136 |
| WBC44.V1.3_at | TGCCAACACTTCGATTTTAGCCTCA | SEQ ID NO: 2137 |
| WBC44.V1.3_at | TTAGCCTCAAGAGACCCATACCTGA | SEQ ID NO: 2138 |
| WBC44.V1.3_at | CCATACCTGACTTCTGACCTATAGA | SEQ ID NO: 2139 |
| WBC881.gRSP.V1.3_at | GCTGCTCTGTCGGTCTGTACAAATA | SEQ ID NO: 2140 |
| WBC881.gRSP.V1.3_at | AACACGACTGGGTCTCGAATACACA | SEQ ID NO: 2141 |
| WBC881.gRSP.V1.3_at | GTTTTTGTGGGTATTGCCTCATTCC | SEQ ID NO: 2142 |
| WBC881.gRSP.V1.3_at | ATTCCATCCCTGAGCTTTGCAGGTA | SEQ ID NO: 2143 |
| WBC881.gRSP.V1.3_at | AACTATGTTCCAGGGTGTTCCTTGT | SEQ ID NO: 2144 |
| WBC881.gRSP.V1.3_at | TTTGTTGCTCTCTTTCCTGGAAATA | SEQ ID NO: 2145 |
| WBC881.gRSP.V1.3_at | GAGACGCTCCTGATTTGTCCATCTA | SEQ ID NO: 2146 |

TABLE 2-continued

| Probe Set Name | Probe Sequence | Sequence Identifier |
|---|---|---|
| WBC881.gRSP.V1.3_at | ATCTACTGCTTTGGTTCCTTGGATC | SEQ ID NO: 2147 |
| WBC881.gRSP.V1.3_at | ATCCACCCATTCTTTCACTTTAAGA | SEQ ID NO: 2148 |
| WBC881.gRSP.V1.3_at | GAGGTCTCTGTATTTTGCAGCTGCC | SEQ ID NO: 2149 |
| WBC881.gRSP.V1.3_at | TTTGCAGCTGCCCTTTTGTAAGAAG | SEQ ID NO: 2150 |

TABLE 3

AMINO ACID SUB-CLASSIFICATION

| Sub-classes | Amino acids |
|---|---|
| Acidic | Aspartic acid, Glutamic acid |
| Basic | Noncyclic: Arginine, Lysine; Cyclic: Histidine |
| Charged | Aspartic acid, Glutamic acid, Arginine, Lysine, Histidine |
| Small | Glycine, Serine, Alanine, Threonine, Proline |
| Polar/neutral | Asparagine, Histidine, Glutamine, Cysteine, Serine, Threonine |
| Polar/large | Asparagine, Glutamine |
| Hydrophobic | Tyrosine, Valine, Isoleucine, Leucine, Methionine, Phenylalanine, Tryptophan |
| Aromatic | Tryptophan, Tyrosine, Phenylalanine |
| Residues that influence chain orientation | Glycine and Proline |

TABLE 4

EXEMPLARY AND PREFERRED AMINO ACID SUBSTITUTIONS

| Original Residue | Exemplary Substitutions | Preferred Substitutions |
|---|---|---|
| Ala | Val, Leu, Ile | Val |
| Arg | Lys, Gln, Asn | Lys |
| Asn | Gln, His, Lys, Arg | Gln |
| Asp | Glu | Glu |
| Cys | Ser | Ser |
| Gln | Asn, His, Lys, | Asn |
| Glu | Asp, Lys | Asp |
| Gly | Pro | Pro |
| His | Asn, Gln, Lys, Arg | Arg |
| Ile | Leu, Val, Met, Ala, Phe, Norleu | Leu |
| Leu | Norleu, Ile, Val, Met, Ala, Phe | Ile |
| Lys | Arg, Gln, Asn | Arg |
| Met | Leu, Ile, Phe | Leu |
| Phe | Leu, Val, Ile, Ala | Leu |
| Pro | Gly | Gly |
| Ser | Thr | Thr |
| Thr | Ser | Ser |
| Trp | Tyr | Tyr |
| Tyr | Trp, Phe, Thr, Ser | Phe |
| Val | Ile, Leu, Met, Phe, Ala, Norleu | Leu |

TABLE 5

RANKING OF GENES BASED ON P VALUE

| Gene Name | Difference | SE | t Value | p Value |
|---|---|---|---|---|
| B1961481.V1.3_at | 1.666322507 | 0.155216771 | 10.735454 | 3.42E−12 |
| WBC026C03_V1.3_at | 1.150792386 | 0.126397807 | 9.10452809 | 1.76E−09 |
| WBC005G04_V1.3_at | 0.894442963 | 0.099099842 | 9.02567496 | 2.40E−09 |
| WBC020C09_V1.3_at | −1.975434651 | 0.227309869 | −8.690492245 | 8.93E−09 |
| WBC007A05_V1.3_at | 0.785659357 | 0.094470794 | 8.31642587 | 3.90E−08 |
| B1961581.V1.3_at | −0.451711505 | 0.055606081 | −8.123419151 | 8.36E−08 |
| BM735170.V1.3_at | 1.433067223 | 0.18234517 | 7.859090675 | 2.38E−07 |
| WBC010C05_V1.3_at | 1.441977213 | 0.189449588 | 7.611403272 | 6.36E−07 |
| B1961434.V1.3_at | 3.424431972 | 0.456186048 | 7.506656526 | 9.64E−07 |
| WBC009D04_V1.3_at | 0.592808107 | 0.081892899 | 7.23882188 | 2.79E−06 |
| B1961434.V1.3_s_at | 3.161162105 | 0.439488349 | 7.192823458 | 3.34E−06 |
| BM780886.V1.3_at | −0.415531897 | 0.057815618 | −7.187191162 | 3.42E−06 |
| WBC004E01_V1.3_at | 0.784558644 | 0.110780118 | 7.082125009 | 5.18E−06 |
| B1961659.V1.3_at | 1.551889116 | 0.219186785 | 7.080212956 | 5.22E−06 |
| WBC008B04_V1.3_at | −0.678906889 | 0.097154867 | −6.98788343 | 7.51E−06 |
| B1961054.V1.3_at | 3.826550139 | 0.547819858 | 6.985051894 | 7.60E−06 |
| BM735449.V1.3_at | 1.170277871 | 0.167733159 | 6.977021578 | 7.84E−06 |
| WBC029A01_V1.3_at | 0.879852727 | 0.127554003 | 6.897884067 | 1.07E−05 |
| BM781436.V1.3_at | −0.314495364 | 0.045881808 | −6.854467519 | 1.27E−05 |
| BM735054.V1.3_at | 1.551493311 | 0.228178727 | 6.799465195 | 1.58E−05 |
| WBC31.V1.3_s_at | −0.680666497 | 0.100518591 | −6.771548352 | 1.76E−05 |
| BM734900.V1.3_at | −1.516282343 | 0.22417215 | −6.763919336 | 1.82E−05 |
| B1961438.V1.3_at | −0.440498303 | 0.065266955 | −6.749178129 | 1.92E−05 |
| B1961550.V1.3_at | 1.3425348 | 0.199300914 | 6.736219995 | 2.02E−05 |
| WBC31.gFSP.V1.3_s_at | −0.591039401 | 0.087840965 | −6.72851668 | 2.09E−05 |
| BM734862.V1.3_at | −0.437281772 | 0.065682696 | −6.657488225 | 2.76E−05 |
| WBC041B04_V1.3_at | 2.184025458 | 0.331137896 | 6.595516498 | 3.52E−05 |
| WBC422.gRSP.V1.3_at | 2.280789862 | 0.346757118 | 6.577485351 | 3.78E−05 |
| WBC007E09_V1.3_at | 0.843052247 | 0.12836437 | 6.567649944 | 3.92E−05 |

TABLE 5-continued

RANKING OF GENES BASED ON P VALUE

| Gene Name | Difference | SE | t Value | p Value |
|---|---|---|---|---|
| BM735031.V1.3_at | 1.059207378 | 0.161421311 | 6.561756739 | 4.01E−05 |
| WBC013G08_V1.3_at | 1.604484661 | 0.246581348 | 6.506918213 | 4.98E−05 |
| BM735096.V1.3_at | −0.527142962 | 0.08133936 | −6.48078572 | 5.51E−05 |
| GI1305528.V1.3_at | 1.698015694 | 0.262662758 | 6.464622952 | 5.87E−05 |
| WBC881.gRSP.V1.3_at | −0.462008718 | 0.071869337 | −6.428453908 | 6.76E−05 |
| WBC44.V1.3_at | 0.616616596 | 0.095944624 | 6.426796735 | 6.81E−05 |
| WBC041C11_V1.3_at | −0.303160563 | 0.047586732 | −6.370695093 | 8.48E−05 |
| WBC036C09_V1.3_at | −0.403578085 | 0.063531632 | −6.352396027 | 9.10E−05 |
| WBC285.gRSP.V1.3_at | −0.519857227 | 0.082704672 | −6.28570571 | 0.000118084 |
| WBC030G08_V1.3_at | 0.657348571 | 0.104593529 | 6.284791949 | 0.000118467 |
| WBC024D07_V1.3_at | 0.345066898 | 0.054910514 | 6.284168071 | 0.000118717 |
| WBC031E09_V1.3_at | 0.945682519 | 0.150758028 | 6.272850147 | 0.000124039 |
| BM734613.V1.3_at | −0.195796173 | 0.031448406 | −6.225948974 | 0.00014889 |
| WBC012F12_V1.3_at | 1.423082668 | 0.230285511 | 6.179644819 | 0.000178261 |
| BM734661.V1.3_at | −0.171573177 | 0.027859225 | −6.158576752 | 0.000193428 |
| WBC022G05_V1.3_at | 0.598971114 | 0.097369199 | 6.151546063 | 0.000198726 |
| WBC032G11_V1.3_at | 0.74658497 | 0.122452588 | 6.096930933 | 0.000245632 |
| WBC028A02_V1.3_at | −0.471494416 | 0.077361546 | −6.094687073 | 0.0002477 |
| WBC024E03_V1.3_at | 0.478892417 | 0.078794071 | 6.077772226 | 0.000264421 |
| BM734607.V1.3_at | 1.687765982 | 0.277888053 | 6.073546394 | 0.000268705 |
| Foe1268.V1.3_at | −0.658520375 | 0.109329632 | −6.023256108 | 0.000326329 |
| WBC035E08_V1.3_at | 0.627315382 | 0.104346849 | 6.011828676 | 0.000340982 |
| BM734719.V1.3_at | −0.480084044 | 0.080066503 | −5.9960661 | 0.000362314 |
| BM781127.V1.3_at | −0.411205914 | 0.068820452 | −5.975053959 | 0.000392606 |
| WBC048H02_V1.3_at | −0.147436743 | 0.024739757 | −5.959506446 | 0.000416788 |
| B1961469.V1.3_at | 0.597662751 | 0.100424518 | 5.951362912 | 0.00042997 |
| WBC021A01_V1.3_at | −0.33752016 | 0.057261491 | −5.894365583 | 0.00053523 |
| B1961499.V1.3_at | −0.204864013 | 0.034949361 | −5.861738376 | 0.000606722 |
| B1961690.V1.3_at | −0.189758849 | 0.032616546 | −5.817870785 | 0.000717784 |
| WBC016C12_V1.3_at | −0.403364998 | 0.069604438 | −5.79510457 | 0.000782617 |
| WBC032C03_V1.3_at | −0.27218489 | 0.047411852 | −5.740861829 | 0.000962987 |
| WBC028D07_V1.3_at | 1.186413699 | 0.208543617 | 5.689043457 | 0.001173814 |
| WBC010B02_V1.3_at | 0.794652845 | 0.13993627 | 5.678676762 | 0.001220044 |
| B1961567.V1.3_at | 0.639519337 | 0.117658674 | 5.435377724 | 0.003046977 |

TABLE 6

RANKING OF GENES BASED ON T VALUE

| | Difference | SE | t Value | p Value |
|---|---|---|---|---|
| WBC020C09_V1.3_at | −1.975434651 | 0.227309869 | −8.690492245 | 8.93E−09 |
| B1961581.V1.3_at | −0.451711505 | 0.055606081 | −8.123419151 | 8.36E−08 |
| BM780886.V1.3_at | −0.415531897 | 0.057815618 | −7.187191162 | 3.42E−06 |
| WBC008B04_V1.3_at | −0.678906889 | 0.097154867 | −6.98788343 | 7.51E−06 |
| BM781436.V1.3_at | −0.314495364 | 0.045881808 | −6.854467519 | 1.27E−05 |
| WBC31.V1.3_s_at | −0.680666497 | 0.100518591 | −6.771548352 | 1.76E−05 |
| BM734900.V1.3_at | −1.516282343 | 0.22417215 | −6.763919336 | 1.82E−05 |
| B1961438.V1.3_at | −0.440498303 | 0.065266955 | −6.749178129 | 1.92E−05 |
| WBC31.gFSP.V1.3_s_at | −0.591039401 | 0.087840965 | −6.72851668 | 2.09E−05 |
| BM734862.V1.3_at | −0.437281772 | 0.065682696 | −6.657488225 | 2.76E−05 |
| BM735096.V1.3_at | −0.527142962 | 0.08133936 | −6.48078572 | 5.51E−05 |
| WBC881.gRSP.V1.3_at | −0.462008718 | 0.071869337 | −6.428453908 | 6.76E−05 |
| WBC041C11_V1.3_at | −0.303160563 | 0.047586732 | −6.370695093 | 8.48E−05 |
| WBC036C09_V1.3_at | −0.403578085 | 0.063531632 | −6.352396027 | 9.10E−05 |
| WBC285.gRSP.V1.3_at | −0.519857227 | 0.082704672 | −6.28570571 | 0.000118084 |
| BM734613.V1.3_at | −0.195796173 | 0.031448406 | −6.225948974 | 0.00014889 |
| BM734661.V1.3_at | −0.171573177 | 0.027859225 | −6.158576752 | 0.000193428 |
| WBC028A02_V1.3_at | −0.471494416 | 0.077361546 | −6.094687073 | 0.0002477 |
| Foe1268.V1.3_at | −0.658520375 | 0.109329632 | −6.023256108 | 0.000326329 |
| BM734719.V1.3_at | −0.480084044 | 0.080066503 | −5.9960661 | 0.000362314 |
| BM781127.V1.3_at | −0.411205914 | 0.068820452 | −5.975053959 | 0.000392606 |
| WBC048H02_V1.3_at | −0.147436743 | 0.024739757 | −5.959506446 | 0.000416788 |
| WBC021A01_V1.3_at | −0.33752016 | 0.057261491 | −5.894365583 | 0.00053523 |
| B1961499.V1.3_at | −0.204864013 | 0.034949361 | −5.861738376 | 0.000606722 |
| B1961690.V1.3_at | −0.189758849 | 0.032616546 | −5.817870785 | 0.000717784 |
| WBC016C12_V1.3_at | −0.403364998 | 0.069604438 | −5.79510457 | 0.000782617 |
| WBC032C03_V1.3_at | −0.27218489 | 0.047411852 | −5.740861829 | 0.000962987 |
| B1961567.V1.3_at | 0.639519337 | 0.117658674 | 5.435377724 | 0.003046977 |
| WBC010B02_V1.3_at | 0.794652845 | 0.13993627 | 5.678676762 | 0.001220044 |

TABLE 6-continued

RANKING OF GENES BASED ON T VALUE

| | Difference | SE | t Value | p Value |
|---|---|---|---|---|
| WBC028D07__V1.3__at | 1.186413699 | 0.208543617 | 5.689043457 | 0.001173814 |
| B1961469.V1.3__at | 0.597662751 | 0.100424518 | 5.951362912 | 0.00042997 |
| WBC035E08__V1.3__at | 0.627315382 | 0.104346849 | 6.011828676 | 0.000340982 |
| BM734607.V1.3__at | 1.687765982 | 0.277888053 | 6.073546394 | 0.000268705 |
| WBC024E03__V1.3__at | 0.478892417 | 0.078794071 | 6.077772226 | 0.000264421 |
| WBC032G11__V1.3__at | 0.74658497 | 0.122452588 | 6.096930933 | 0.000245632 |
| WBC022G05__V1.3__at | 0.598971114 | 0.097369199 | 6.151546063 | 0.000198726 |
| WBC012F12__V1.3__at | 1.423082668 | 0.230285511 | 6.179644819 | 0.000178261 |
| WBC031E09__V1.3__at | 0.945682519 | 0.150758028 | 6.272850147 | 0.000124039 |
| WBC024D07__V1.3__at | 0.345066898 | 0.054910514 | 6.284168071 | 0.000118717 |
| WBC030G08__V1.3__at | 0.657348571 | 0.104593529 | 6.284791949 | 0.000118467 |
| WBC44.V1.3__at | 0.616616596 | 0.095944624 | 6.426796735 | 6.81E−05 |
| GI1305528.V1.3__at | 1.698015694 | 0.262662758 | 6.464622952 | 5.87E−05 |
| WBC013G08__V1.3__at | 1.604484661 | 0.246581348 | 6.506918213 | 4.98E−05 |
| BM735031.V1.3__at | 1.059207378 | 0.161421311 | 6.561756739 | 4.01E−05 |
| WBC007E09__V1.3__at | 0.843052247 | 0.12836437 | 6.567649944 | 3.92E−05 |
| WBC422.gRSP.V1.3__at | 2.280789862 | 0.346757118 | 6.577485351 | 3.78E−05 |
| WBC041B04__V1.3__at | 2.184025458 | 0.331137896 | 6.595516498 | 3.52E−05 |
| B1961550.V1.3__at | 1.3425348 | 0.199300914 | 6.736219995 | 2.02E−05 |
| BM735054.V1.3__at | 1.551493311 | 0.228178727 | 6.799465195 | 1.58E−05 |
| WBC029A01__V1.3__at | 0.879852727 | 0.127554003 | 6.897884067 | 1.07E−05 |
| BM735449.V1.3__at | 1.170277871 | 0.167733159 | 6.977021578 | 7.84E−06 |
| B1961054.V1.3__at | 3.826550139 | 0.547819858 | 6.985051894 | 7.60E−06 |
| B1961659.V1.3__at | 1.551889116 | 0.219186785 | 7.080212956 | 5.22E−06 |
| WBC004E01__V1.3__at | 0.784558644 | 0.110780118 | 7.082125009 | 5.18E−06 |
| B1961434.V1.3__s__at | 3.161162105 | 0.439488349 | 7.192823458 | 3.34E−06 |
| WBC009D04__V1.3__at | 0.592808107 | 0.081892899 | 7.23882188 | 2.79E−06 |
| B1961434.V1.3__at | 3.424431972 | 0.456186048 | 7.506656526 | 9.64E−07 |
| WBC010C05__V1.3__at | 1.441977213 | 0.189449588 | 7.611403272 | 6.36E−07 |
| BM735170.V1.3__at | 1.433067223 | 0.18234517 | 7.859090675 | 2.38E−07 |
| WBC007A05__V1.3__at | 0.785659357 | 0.094470794 | 8.31642587 | 3.90E−08 |
| WBC005G04__V1.3__at | 0.894442963 | 0.099099842 | 9.02567496 | 2.40E−09 |
| WBC026C03__V1.3__at | 1.150792386 | 0.126397807 | 9.10452809 | 1.76E−09 |
| B1961481.V1.3__at | 1.666322507 | 0.155216771 | 10.735454 | 3.42E−12 |

TABLE 7

EHV-1 GROUP 1: MEANS OF CLINICAL & HEMATOLOGICAL PARAMETERS

| | Day 0 | Day 2 | Day 4 | Day 6 | Day 13 | Day 20 | F Ratio | P value |
|---|---|---|---|---|---|---|---|---|
| HR | 52.45 | 54.95 | 54.68 | 47.95 | 47.48 | 52.45 | 3.79 | 0.019 |
| RR | 27.48 | 22.66 | 37.16 | 28.66 | 20.72 | 19.66 | 3.06 | 0.04 |
| Temp | 38.15 | 38.10 | 39.37 | 37.87 | 38.45 | 37.95 | 9.81 | 0 |
| PCV | 34.4006 | 33.2173 | 33.779 | 32.7173 | 32.979 | 35.2173 | 0.535 | 0.747 |
| TSP | 61.6314 | 61.9314 | 67.3297 | 60.1814 | 65.3297 | 65.9314 | 4.563 | 0.009 |
| Fib | 1.8429 | 3.1263 | 2.1113 | 3.3763 | 0.9113 | 3.3763 | 5.871 | 0.003 |
| WCC | 10.3866 | 12.3899 | 9.4875 | 11.1899 | 9.4695 | 9.4899 | 4.443 | 0.01 |
| Neuts | 5.491 | 6.0105 | 4.933 | 5.3505 | 3.927 | 3.813 | 3.331 | 0.03 |
| Lymphs | 4.0605 | 5.5708 | 4.0228 | 5.2033 | 4.3228 | 4.3983 | 5.736 | 0.003 |

HR = heart rate,
RR = respiratory rate,
Temp = rectal temperature,
PCV = packed cell volume (blood),
TSP = total serum protein,
Fib = fibrinogen,
WCC = -white blood cell count,
Neut = neutrophils,
Lymphs = lymphocytes.

TABLE 8

| Day | Sensitivity | Specificity | AUC - Raw | AUC - Lloyd |
|---|---|---|---|---|
| 2 | 1.000 | 0.800 | 1 | 0.886 |
| 4 | 1.000 | 0.800 | 1.000 | 0.941 |
| 13 | 0.667 | 0.400 | 0.500 | 0.467 |
| 20 | 0.500 | 0.800 | 0.700 | 0.645 |

TABLE 9

PREDICTED CLASS AND DISCRIMINANT SCORE FOR EACH SAMPLE TAKEN FOR GROUP 2 FOALS

| Date | Horse ID | Day of Trial | Pos/Neg | Index of Gene Expression |
|---|---|---|---|---|
| 8 Apr. 2003 | 360 | 0 | neg | −0.09 |
| 10 Apr. 2003 | 360 | 2 | pos | 0.43 |

TABLE 9-continued

PREDICTED CLASS AND DISCRIMINANT SCORE FOR EACH SAMPLE TAKEN FOR GROUP 2 FOALS

| Date | Horse ID | Day of Trial | Pos/Neg | Index of Gene Expression |
|---|---|---|---|---|
| 12 Apr. 2003 | 360 | 4 | neg | −1.55 |
| 14 Apr. 2003 | 360 | 6 | neg | −1.73 |
| 29 Apr. 2003 | 360 | 21 | neg | −1.45 |
| 1 May 2003 | 360 | 23 | neg | −0.91 |
| 3 May 2003 | 360 | 25 | neg | −0.78 |
| 5 May 2003 | 360 | 27 | neg | −1.52 |
| 12 May 2003 | 360 | 34 | neg | −2.28 |
| 19 May 2003 | 360 | 41 | neg | −2.74 |
| 8 Apr. 2003 | 362 | 0 | pos | 1.69 |
| 10 Apr. 2003 | 362 | 2 | pos | 0.96 |
| 12 Apr. 2003 | 362 | 4 | neg | −0.56 |
| 14 Apr. 2003 | 362 | 6 | pos | 0.51 |
| 12 Apr. 2003 | 362 | 13 | neg | −1.45 |
| 28 Apr. 2003 | 362 | 20 | neg | −2.41 |
| 29 Apr. 2003 | 362 | 21 | neg | −1.31 |
| 1 May 2003 | 362 | 23 | neg | −1.08 |
| 3 May 2003 | 362 | 25 | neg | −1.97 |
| 12 May 2003 | 362 | 34 | neg | −1.28 |
| 19 May 2003 | 362 | 41 | neg | −2.33 |
| 8 Apr. 2003 | 364 | 0 | pos | 0.45 |
| 10 Apr. 2003 | 364 | 2 | neg | −0.08 |
| 12 Apr. 2003 | 364 | 4 | neg | −1.03 |
| 14 Apr. 2003 | 364 | 6 | neg | −1.31 |
| 12 Apr. 2003 | 364 | 13 | neg | −1.02 |
| 28 Apr. 2003 | 364 | 20 | neg | −1.5 |
| 29 Apr. 2003 | 364 | 21 | pos | 0.03 |
| 1 May 2003 | 364 | 23 | neg | −0.32 |
| 3 May 2003 | 364 | 25 | neg | −0.74 |
| 5 May 2003 | 364 | 27 | neg | −1.56 |
| 12 May 2003 | 364 | 34 | neg | −1.35 |
| 19 May 2003 | 364 | 41 | neg | −1.51 |
| 8 Apr. 2003 | 366 | 0 | neg | −1.68 |
| 10 Apr. 2003 | 366 | 2 | neg | −1.42 |
| 12 Apr. 2003 | 366 | 4 | neg | −2.09 |
| 14 Apr. 2003 | 366 | 6 | neg | −1.68 |
| 12 Apr. 2003 | 366 | 13 | neg | −0.75 |
| 28 Apr. 2003 | 366 | 20 | neg | −1.97 |
| 29 Apr. 2003 | 366 | 21 | neg | −0.76 |
| 1 May 2003 | 366 | 23 | neg | −0.92 |
| 3 May 2003 | 366 | 25 | neg | −1.34 |
| 5 May 2003 | 366 | 27 | neg | −1.17 |
| 12 May 2003 | 366 | 34 | neg | −1.41 |
| 19 May 2003 | 366 | 41 | neg | −1.68 |
| 8 Apr. 2003 | 368 | 0 | pos | 1.22 |
| 10 Apr. 2003 | 368 | 2 | pos | 0.95 |
| 12 Apr. 2003 | 368 | 4 | neg | −2.02 |
| 14 Apr. 2003 | 368 | 6 | neg | −0.9 |
| 12 Apr. 2003 | 368 | 13 | neg | −2.08 |
| 28 Apr. 2003 | 368 | 20 | neg | −1.54 |
| 29 Apr. 2003 | 368 | 21 | neg | −1.97 |
| 1 May 2003 | 368 | 23 | neg | −1.34 |
| 3 May 2003 | 368 | 25 | pos | 0.37 |
| 5 May 2003 | 368 | 27 | neg | −0.48 |
| 12 May 2003 | 368 | 34 | neg | −3.54 |
| 19 May 2003 | 368 | 41 | neg | −1.96 |
| 8 Apr. 2003 | 369 | 0 | neg | −0.86 |
| 10 Apr. 2003 | 369 | 2 | neg | −1 |
| 12 Apr. 2003 | 369 | 4 | pos | 1.18 |
| 14 Apr. 2003 | 369 | 6 | neg | −0.61 |
| 12 Apr. 2003 | 369 | 13 | neg | −1.14 |
| 28 Apr. 2003 | 369 | 20 | neg | −1.21 |
| 29 Apr. 2003 | 369 | 21 | neg | −1.19 |
| 1 May 2003 | 369 | 23 | neg | −1.77 |
| 3 May 2003 | 369 | 25 | neg | −1.19 |
| 5 May 2003 | 369 | 27 | neg | −1.99 |
| 12 May 2003 | 369 | 34 | neg | −1.53 |
| 19 May 2003 | 369 | 41 | neg | −1.52 |
| 8 Apr. 2003 | 375 | 0 | neg | −2.15 |
| 10 Apr. 2003 | 375 | 2 | pos | 1.97 |
| 12 Apr. 2003 | 375 | 4 | pos | 1.66 |
| 14 Apr. 2003 | 375 | 6 | pos | 0.66 |
| 12 Apr. 2003 | 375 | 13 | neg | −1.11 |
| 28 Apr. 2003 | 375 | 20 | neg | −0.6 |
| 29 Apr. 2003 | 375 | 21 | neg | −1.1 |
| 1 May 2003 | 375 | 23 | neg | −2.47 |
| 3 May 2003 | 375 | 25 | neg | −2.4 |
| 5 May 2003 | 375 | 27 | neg | −0.67 |
| 12 May 2003 | 375 | 34 | neg | −4.03 |
| 19 May 2003 | 375 | 41 | neg | −1 |

TABLE 10

TWO GENES SELECTED

| Sensitivity | Specificity | Success | Gene 1 | Gene 2 |
|---|---|---|---|---|
| 0.8913 | 0.8621 | 0.8800 | WBC026C03 | WBC881 |
| 0.8913 | 0.8621 | 0.8800 | WBC026C03 | WBC007A05 |
| 0.8913 | 0.8621 | 0.8800 | WBC026C03 | BM735054 |
| 0.8913 | 0.8621 | 0.8800 | WBC012F12 | WBC026C03 |
| 0.8913 | 0.8621 | 0.8800 | WBC032G11 | WBC026C03 |
| 0.8913 | 0.8621 | 0.8800 | BM781127 | WBC026C03 |
| 0.8913 | 0.8621 | 0.8800 | B1961659 | WBC026C03 |
| 0.8913 | 0.8621 | 0.8800 | WBC026C03 | BM734719 |
| 0.8913 | 0.8621 | 0.8800 | WBC026C03 | BM734719 |
| 0.8913 | 0.8621 | 0.8800 | WBC007E09 | WBC026C03 |
| 0.9130 | 0.8276 | 0.8800 | B1961499 | GI1305528 |
| 0.8913 | 0.8621 | 0.8800 | B1961567 | WBC026C03 |
| 0.9130 | 0.8276 | 0.8800 | GI1305528 | B1961499 |
| 0.8913 | 0.8621 | 0.8800 | WBC026C03 | WBC032G11 |
| 0.8913 | 0.8621 | 0.8800 | WBC026C03 | BM781127 |
| 0.8913 | 0.8621 | 0.8800 | B1961567 | WBC026C03 |
| 0.8913 | 0.8621 | 0.8800 | WBC031E09 | WBC026C03 |
| 0.8913 | 0.8621 | 0.8800 | WBC026C03 | WBC881 |
| 0.8913 | 0.8621 | 0.8800 | BM735449 | WBC026C03 |
| 0.9130 | 0.8276 | 0.8800 | GI1305528 | B1961499 |

TABLE 11

THREE GENES SELECTED

| Sensitivity | Specificity | Success | Gene 1 | Gene 2 | Gene 3 |
|---|---|---|---|---|---|
| 0.9348 | 0.8276 | 0.8933 | WBC028A02 | B1961499 | WBC024D07 |
| 0.9348 | 0.7931 | 0.8800 | BM780886 | GI1305528 | BM735096 |
| 0.8913 | 0.8621 | 0.8800 | WBC041C11 | WBC026C03 | BM734900 |
| 0.9348 | 0.7931 | 0.8800 | WBC048H02 | WBC020C09 | BM734900 |
| 0.8913 | 0.8621 | 0.8800 | WBC020C09 | WBC026C03 | WBC881 |
| 0.9130 | 0.8276 | 0.8800 | WBC026C03 | B1961581 | BM735096 |
| 0.9565 | 0.7586 | 0.8800 | WBC44 | BM734862 | B1961690 |
| 0.9565 | 0.7586 | 0.8800 | B1961499 | BM734607 | WBC048H02 |
| 0.8913 | 0.8621 | 0.8800 | WBC020C09 | WBC007E09 | WBC026C03 |
| 0.8913 | 0.8621 | 0.8800 | WBC010B02 | WBC026C03 | WBC881 |

TABLE 11-continued

THREE GENES SELECTED

| Sensitivity | Specificity | Success | Gene 1 | Gene 2 | Gene 3 |
|---|---|---|---|---|---|
| 0.9130 | 0.8276 | 0.8800 | Foe1268 | WBC31 | WBC048H02 |
| 0.9565 | 0.7586 | 0.8800 | WBC041B04 | B1961438 | BM734862 |
| 0.9130 | 0.8276 | 0.8800 | WBC010C05 | B1961438 | WBC041B04 |
| 0.9130 | 0.8276 | 0.8800 | WBC31 | Foe1268 | WBC048H02 |
| 0.8913 | 0.8621 | 0.8800 | WBC022G05 | WBC048H02 | WBC020C09 |
| 0.8913 | 0.8621 | 0.8800 | WBC022G05 | WBC048H02 | B1961581 |
| 0.8913 | 0.8276 | 0.8667 | WBC048H02 | B1961054 | BM735170 |
| 0.8913 | 0.8276 | 0.8667 | BM735054 | WBC026C03 | BM735449 |
| 0.9130 | 0.7931 | 0.8667 | WBC028A02 | WBC048H02 | B1961481 |
| 0.9130 | 0.7931 | 0.8667 | WBC012F12 | B1961499 | BM734613 |

TABLE 12

FOUR GENES SELECTED

| Sensitivity | Specificity | Success | Gene 1 | Gene 2 | Gene 3 | Gene 4 |
|---|---|---|---|---|---|---|
| 0.9348 | 0.8621 | 0.9067 | B1961054 | WBC009D04 | B1961481 | B1961499 |
| 0.9565 | 0.8276 | 0.9067 | WBC009D04 | WBC021A01 | B1961499 | WBC048H02 |
| 0.9348 | 0.8276 | 0.8933 | WBC009D04 | WBC422 | BM734719 | B1961481 |
| 0.9130 | 0.8621 | 0.8933 | B1961469 | B1961481 | B1961434 | WBC009D04 |
| 0.9565 | 0.7931 | 0.8933 | WBC44 | WBC016C12 | B1961499 | BM735096 |
| 0.9130 | 0.8276 | 0.8800 | WBC048H02 | B1961499 | WBC31 | WBC041B04 |
| 0.9130 | 0.8276 | 0.8800 | WBC048H02 | WBC026C03 | WBC005G04 | B1961581 |
| 0.9130 | 0.8276 | 0.8800 | B1961499 | WBC024D07 | WBC005G04 | WBC048H02 |
| 0.9348 | 0.7931 | 0.8800 | BM735096 | WBC010B02 | WBC041B04 | WBC024E03 |
| 0.9565 | 0.7586 | 0.8800 | BM735054 | WBC013G08 | B1961690 | BM735096 |
| 0.9130 | 0.8276 | 0.8800 | B1961581 | B1961438 | GI1305528 | WBC020C09 |
| 0.9348 | 0.7931 | 0.8800 | B1961499 | BM735054 | WBC007A05 | BM735096 |
| 0.9130 | 0.8276 | 0.8800 | WBC022G05 | GI1305528 | BM735096 | BM734862 |
| 0.8913 | 0.8621 | 0.8800 | WBC041C11 | WBC048H02 | WBC020C09 | WBC030G08 |
| 0.9348 | 0.7931 | 0.8800 | WBC041B04 | B1961659 | WBC31 | B1961499 |
| 0.9348 | 0.7931 | 0.8800 | WBC022G05 | B1961438 | BM780886 | B1961499 |
| 0.9130 | 0.8276 | 0.8800 | WBC036C09 | WBC285 | B1961581 | WBC041B04 |
| 0.8913 | 0.8621 | 0.8800 | WBC026C03 | BM734900 | WBC032G11 | WBC031E09 |
| 0.9130 | 0.8276 | 0.8800 | BM735054 | WBC022G05 | WBC041C11 | WBC048H02 |
| 0.9130 | 0.8276 | 0.8800 | WBC048H02 | WBC021A01 | BM780886 | BM735054 |

TABLE 13

FIVE GENES SELECTED

| Sensitivity | Specificity | Success | Gene 1 | Gene 2 | Gene 3 | Gene 4 | Gene 5 |
|---|---|---|---|---|---|---|---|
| 0.9348 | 0.8621 | 0.9067 | BM734900 | BM734719 | WBC028D07 | B1961481 | WBC041B04 |
| 0.9348 | 0.8621 | 0.9067 | WBC048H02 | BM735096 | WBC029A01 | B1961581 | WBC026C03 |
| 0.9348 | 0.8276 | 0.8933 | WBC031E09 | WBC029A01 | B1961499 | WBC048H02 | WBC007A05 |
| 0.8913 | 0.8966 | 0.8933 | WBC31 | BM735054 | B1961499 | B1961481 | WBC029A01 |
| 0.9130 | 0.8621 | 0.8933 | B1961054 | B1961481 | BM735054 | BM734607 | BM735096 |
| 0.9565 | 0.7931 | 0.8933 | B1961054 | WBC009D04 | WBC048H02 | B1961438 | B1961499 |
| 0.9348 | 0.8276 | 0.8933 | B1961499 | B1961481 | B1961434 | B1961690 | WBC028D07 |
| 0.9348 | 0.8276 | 0.8933 | B1961054 | WBC009D04 | WBC024D07 | BM735449 | B1961481 |
| 0.8913 | 0.8966 | 0.8933 | WBC048H02 | WBC022G05 | B1961581 | WBC44 | WDC041C11 |
| 0.9130 | 0.8621 | 0.8933 | BM735449 | B1961434 | WBC009D04 | B1961481 | BM734862 |
| 0.8913 | 0.8966 | 0.8933 | WBC009D04 | B1961481 | BM734900 | WBC285 | B1961434 |
| 0.9348 | 0.8276 | 0.8933 | B1961499 | WBC012F12 | WBC028D07 | WBC041B04 | BM735096 |
| 0.9348 | 0.7931 | 0.8800 | WBC008B04 | WBC048H02 | BM734607 | WBC007E09 | WBC44 |
| 0.9130 | 0.8276 | 0.8800 | BM735054 | BM781436 | BM735449 | WBC028A02 | B1961581 |
| 0.9348 | 0.7931 | 0.8800 | WBC035E08 | WBC285 | WBC004E01 | B1961499 | BM734719 |
| 0.9348 | 0.7931 | 0.8800 | WBC31 | WBC022G05 | BM735054 | WBC007A05 | WBC285 |
| 0.9565 | 0.7586 | 0.8800 | WBC022G05 | WBC021A01 | B1961499 | B1961438 | WBC032C03 |
| 0.9130 | 0.8276 | 0.8800 | B1961550 | BM734613 | BM780886 | B1961581 | BM735054 |
| 0.9130 | 0.8276 | 0.8800 | WBC032G11 | WBC024D07 | BM781127 | BM734613 | B1961499 |
| 0.8913 | 0.8621 | 0.8800 | WBC881 | BM735449 | BM781127 | WBC026C03 | WBC010B02 |

TABLE 14

SIX GENES SELECTED

| Sensitivity | Specificity | Success | Gene 1 | Gene 2 | Gene 3 | Gene 4 | Gene 5 | Gene 6 |
|---|---|---|---|---|---|---|---|---|
| 0.9348 | 0.8966 | 0.9200 | BM735096 | WBC007E09 | WBC041B04 | WBC016C12 | B1961054 | B1961481 |
| 0.9348 | 0.8621 | 0.9067 | WBC048H02 | WBC041B04 | GI1305528 | B1961659 | WBC422 | B1961481 |
| 0.9348 | 0.8621 | 0.9067 | WBC009D04 | B1961481 | B1961567 | B1961434 | BM734862 | B1961499 |
| 0.9130 | 0.8966 | 0.9067 | B1961481 | WBC048H02 | WBC035E08 | B1961434 | WBC009D04 | WBC009D04 |
| 0.9348 | 0.8621 | 0.9067 | WBC005G04 | BM734900 | WBC020C09 | B1961434 | WBC009D04 | B1961481 |
| 0.9565 | 0.8276 | 0.9067 | WBC010B02 | B1961434 | WBC009D04 | WBC041B04 | WBC028A02 | B1961481 |
| 0.9348 | 0.8621 | 0.9067 | B1961659 | WBC032G11 | WBC048H02 | BM735096 | WBC041B04 | B1961581 |
| 0.9348 | 0.8621 | 0.9067 | BM735449 | BM734661 | BM734607 | WBC285 | BM735054 | WBC022G05 |
| 0.9565 | 0.8276 | 0.9067 | B1961690 | WBC022G05 | B1961499 | WBC016C12 | WBC013G08 | B1961434 |
| 0.9348 | 0.8276 | 0.8933 | GI1305528 | BM734613 | BM735096 | BM734862 | B1961499 | BM780886 |
| 0.9565 | 0.7931 | 0.8933 | B1961438 | WBC048H02 | WBC028D07 | B1961499 | BM734900 | B1961567 |
| 0.9130 | 0.8621 | 0.8933 | WBC44 | B1961659 | WBC024E03 | B1961581 | BM734719 | BM734661 |
| 0.9130 | 0.8621 | 0.8933 | WBC422 | B1961481 | WBC007A05 | WBC041B04 | WBC005G04 | BM734607 |
| 0.9130 | 0.8621 | 0.8933 | B1961481 | WBC024E03 | WBC009D04 | WBC032C03 | Foe1268 | WBC422 |
| 0.9348 | 0.8276 | 0.8933 | BM735449 | B1961499 | WBC028A02 | WBC285 | WBC44 | WBC004E01 |
| 0.8913 | 0.8966 | 0.8933 | WBC036C09 | B1961581 | WBC005G04 | WBC048H02 | B1961434 | Foe1268 |
| 0.8913 | 0.8621 | 0.8800 | WBC005G04 | WBC013G08 | WBC048H02 | WBC007E09 | B1961581 | WBC004E01 |
| 0.9348 | 0.7931 | 0.8800 | BM735054 | BM734661 | B1961499 | B1961690 | BM780886 | WBC031E09 |
| 0.9130 | 0.8276 | 0.8800 | BM735054 | WBC005G04 | B1961434 | WBC028D07 | BM734719 | B1961581 |
| 0.9130 | 0.8276 | 0.8800 | B1961438 | B1961581 | WBC048H02 | BM735054 | BM735170 | GI1305528 |

TABLE 15

SEVEN GENES SELECTED

| Sensitivity | Specificity | Success | Gene 1 | Gene 2 | Gene 3 | Gene 4 | Gene 5 | Gene 6 | Gene 7 |
|---|---|---|---|---|---|---|---|---|---|
| 0.9348 | 0.8621 | 0.9067 | B1961434 | BM781127 | WBC31 | WBC31 | WBC030G08 | WBC048H02 | BM735054 |
| 0.9348 | 0.8621 | 0.9067 | B1961481 | WBC009D04 | Foe1268 | WBC016C12 | WBC007E09 | WBC035E08 | B1961054 |
| 0.9130 | 0.8966 | 0.9067 | WBC022G05 | WBC009D04 | WBC021A01 | B1961481 | BM734719 | WBC004E01 | B1961434 |
| 0.9348 | 0.8276 | 0.8933 | WBC008B04 | BM735096 | B1961434 | BM735054 | BM781127 | WBC31 | B1961567 |
| 0.9348 | 0.8276 | 0.8933 | WBC028D07 | B1961481 | BM735031 | B1961434 | WBC048H02 | B1961054 | WBC009D04 |
| 0.9348 | 0.8276 | 0.8933 | WBC041B04 | BM781127 | WBC032C03 | WBC31 | BM735054 | B1961434 | WBC030G08 |
| 0.9565 | 0.7931 | 0.8933 | WBC31 | WBC44 | WBC007A05 | BM735054 | WBC048H02 | B1961469 | BM734607 |
| 0.9130 | 0.8621 | 0.8933 | WBC008B04 | WBC31 | B1961499 | B1961054 | WBC048H02 | WBC016C12 | BM734719 |
| 0.9348 | 0.8276 | 0.8933 | BM735054 | B1961054 | WBC422 | WBC31 | BM734661 | WBC048H02 | WBC007E09 |
| 0.9348 | 0.8276 | 0.8933 | B1961690 | BM734661 | WBC009D04 | WBC422 | B1961481 | B1961567 | WBC031E09 |
| 0.9130 | 0.8621 | 0.8933 | WBC048H02 | WBC31 | WBC024E03 | WBC041C11 | BM735054 | B1961054 | WBC31 |
| 0.9130 | 0.8621 | 0.8933 | WBC022G05 | B1961550 | WBC009D04 | B1961434 | B1961481 | B1961438 | WBC024E03 |
| 0.9348 | 0.8276 | 0.8933 | WBC041C11 | WBC026C03 | B1961690 | WBC005G04 | WBC032G11 | B1961581 | B1961499 |
| 0.9348 | 0.8276 | 0.8933 | WBC005G04 | B1961054 | WBC004E01 | BM781127 | BM735096 | B1961499 | GI1305528 |
| 0.9348 | 0.8276 | 0.8933 | BM735096 | WBC009D04 | BM735054 | WBC028D07 | WBC041B04 | WBC032G11 | BM734719 |
| 0.9130 | 0.8621 | 0.8933 | WBC008B04 | BM780886 | B1961438 | BM735096 | BM735054 | WBC013G08 | WBC007E09 |
| 0.9348 | 0.8276 | 0.8933 | BM735096 | B1961581 | WBC31 | WBC041B04 | B1961434 | WB0009D04 | B1961690 |
| 0.9130 | 0.8621 | 0.8933 | WBC020C09 | BM735449 | WBC009D04 | B1961481 | WBC022G05 | B1961434 | WBC036C09 |
| 0.8913 | 0.8621 | 0.8800 | B1961054 | WBC285 | WBC026C03 | WBC016C12 | BM735054 | WBC007A05 | BM734661 |
| 0.9130 | 0.8276 | 0.8800 | WBC008B04 | B1961481 | WBC009D04 | B1961550 | WBC422 | WBC021A01 | Foe1268 |

TABLE 16

EIGHT GENES SELECTED

| Sensitivity | Specificity | Success | Genes (8) |
|---|---|---|---|
| 0.9565 | 0.8621 | 0.9200 | BM735054; B1961054; WBC009D04; B1961438; BM780886; BM735449; WBC020C09; WBC010B02 |
| 0.9348 | 0.8621 | 0.9067 | BM735031; WBC032G11; BM734661; WBC44; B1961054; WBC028D07; B1961481; WBC009D04 |
| 0.9130 | 0.8966 | 0.9067 | WBC029A01; B1961434; WBC041B04; GI1305528; B1961438; Foe1268; WBC048H02; WBC44 |
| 0.9565 | 0.8276 | 0.9067 | WBC007E09; B1961581; BM781127; WBC010B02; BM734613; WBC005G04; B1961438; WBC009D04 |
| 0.9565 | 0.8276 | 0.9067 | WBC026C03; WBC020C09; WBC285; BM781127; WBC010B02; WBC028A02; BM734719; WBC005G04 |
| 0.9565 | 0.7931 | 0.8933 | WBC031E09; BM735096; WBC013G08; B1961434; WBC009D04; B1961499; WBC041B04; BM734900 |
| 0.8913 | 0.8966 | 0.8933 | B1961434; B1961481; B1961438; WBC024E03; WBC009D04; B1961469; WBC036C09; BM734900 |
| 0.9130 | 0.8621 | 0.8933 | BM781127; BM735096; BM734719; BM735031; B1961438; BM735054; B1961481; B1961434 |
| 0.9348 | 0.8276 | 0.8933 | WBC007E09; WBC048H02; WBC036C09; WBC31; BM735054; WBC028D07; BM735096; B1961499 |
| 0.9130 | 0.8621 | 0.8933 | WBC041C11; WBC041B04; WBC022G05; WBC422; B1961481; GI1305528; WBC030G08; WBC013G08 |
| 0.9348 | 0.8276 | 0.8933 | B1961469; B1961690; WBC022G05; WBC010C05; B1961499; BM735054; WBC036C09; WBC028D07 |
| 0.9348 | 0.8276 | 0.8933 | WBC008B04; BM781127; BM735096; WBC041B04; WBC032G11; WBC31; B1961438; WBC422 |
| 0.9130 | 0.8621 | 0.8933 | BM734607; WBC026C03; WBC028D07; B1961581; BM735096; B1961690; WBC041C11; WBC010C05 |
| 0.9348 | 0.8276 | 0.8933 | B1961438; WBC024D07; WBC422; BM735054; BM734607; BM734661; WBC031E09; WBC041B04 |
| 0.9565 | 0.7931 | 0.8933 | BM780886; B1961438; B1961499; WBC004E01; WBC041C11; WBC036C09; B1961581; WBC032C03 |
| 0.9348 | 0.8276 | 0.8933 | BM735096; WBC041B04; WBC31; B1961434; B1961581; B1961567; B1961469; WBC009D04 |
| 0.8913 | 0.8966 | 0.8933 | WBC032G11; B1961481; WBC036C09; WBC005G04; WBC009D04; WBC016C12; WBC029A01; B1961434 |

TABLE 16-continued

EIGHT GENES SELECTED

| Sensitivity | Specificity | Success | Genes (8) |
|---|---|---|---|
| 0.9348 | 0.8276 | 0.8933 | B1961054; GI1305528; BM735054; WBC024E03; WBC021A01; Foe1268; B1961581; BM735096 |
| 0.8913 | 0.8966 | 0.8933 | B1961481; WBC009D04; WBC016C12; BM734661; WBC030G08; WBC010C05; WBC005G04; B1961434 |
| 0.8913 | 0.8966 | 0.8933 | BM735031; Foe1268; B1961481; WBC004E01; WBC024E03; WBC048H02; WBC041B04; WBC010C05 |

TABLE 17

NINE GENES SELECTED

| Sensitivity | Specificity | Success | Genes (9) |
|---|---|---|---|
| 0.9348 | 0.8966 | 0.9200 | WBC021A01; B1961499; WBC028D07; WBC009D04; WBC031E09; B1961054; B1961481; WBC31; BM780886 |
| 0.9348 | 0.8966 | 0.9200 | B1961659; BM735054; BM734719; B1961054; WBC024E03; B1961550; BM734900; B1961481; WBC31 |
| 0.9565 | 0.8621 | 0.9200 | BM734719; Foe1268; B1961567; WBC020C09; WBC007A05; GI1305528; WBC009D04; B1961481; B1961434 |
| 0.9348 | 0.8966 | 0.9200 | B1961481; B1961054; WBC008B04; WBC041C11; WBC009D04; WBC029A01; BM735031; WBC012F12; WBC041B04 |
| 0.9348 | 0.8621 | 0.9067 | BM735096; WBC31; WBC44; B1961434; BM734900; GI1305528; WBC024E03; BM734862; B1961481 |
| 0.9348 | 0.8621 | 0.9067 | WBC028D07; WBC035E08; WBC041B04; B1961438; WBC022G05; WBC020C09; GI1305528; WBC024E03; WBC285 |
| 0.9348 | 0.8621 | 0.9067 | WBC31; WBC009D04; BM734719; B1961481; WBC030G08; B1961054; BM780886; WBC026C03; WBC024D07 |
| 0.9348 | 0.8621 | 0.9067 | B1961469; WBC028D07; BM735096; WBC007A05; BM781436; WBC041B04; WBC007E09; B1961581; B1961054 |
| 0.9130 | 0.8966 | 0.9067 | B1961054; WBC009D04; B1961567; WBC31; WBC016C12; WBC285; WBC44; B1961481; B1961434 |
| 0.8913 | 0.9310 | 0.9067 | WBC030G08; B1961567; GI1305528; B1961481; WBC422; B1961054; BM734900; BM734613; BM735054 |
| 0.9130 | 0.8966 | 0.9067 | WBC030G08; B1961434; BM735054; BM781127; B1961550; WBC010C05; B1961581; WBC032G11 |
| 0.9348 | 0.8276 | 0.8933 | WBC048H02; WBC041C11; WBC31; WBC005G04; WBC032C03; WBC013G08; BM734862; B1961581; BM734613 |
| 0.9130 | 0.8621 | 0.8933 | WBC016C12; B1961499; B1961054; BM735096; WBC035E08; WBC022G05; WBC032G11; WBC048H02; BM734719 |
| 0.9565 | 0.7931 | 0.8933 | WBC009D04; WBC022G05; Foe1268; B1961434; B1961481; WBC012F12; BM735031; WBC016C12; B1961499 |
| 0.9348 | 0.8276 | 0.8933 | WBC31; B1961690; WBC422; WBC022G05; WBC020C09; B1961581; B1961438; WBC041B04; WBC024E03; BM780886; |
| 0.8913 | 0.8966 | 0.8933 | B1961054; BM735170; GI1305528; WBC285; B1961659; WBC013G08; WBC007E09; BM735054 |
| 0.9130 | 0.8621 | 0.8933 | WBC036C09; BM735054; WBC028A02; BM780886; WBC030G08; B1961434; WBC048H02; WBC029A01; BM781436 |
| 0.9130 | 0.8621 | 0.8933 | BM781436; WBC041B04; B1961054; WBC024E03; BM734719; WBC44; B1961499; WBC028D07; WBC285 |
| 0.8913 | 0.8966 | 0.8933 | B1961567; B1961481; WBC032C03; WBC009D04; WBC016C12; BM734719; WBC008B04; WBC285; B1961434 |
| 0.9130 | 0.8621 | 0.8933 | BM735031; GI1305528; Foe1268; WBC422; WBC009D04; B1961481; BM734607; WBC041C11; B1961054 |

TABLE 18

TEN GENES SELECTED

| Sensitivity | Specificity | Success | Genes (10) |
|---|---|---|---|
| 0.9348 | 0.9310 | 0.9333 | WBC029A01; WBC009D04; BM735031; B1961550; BM735054; B1961054; BM780886; B1961659; B1961481; WBC041B04 |
| 0.9130 | 0.9310 | 0.9200 | WBC009D04; WBC007E09; B1961054; BM735170; WBC026C03; WBC029A01; BM781127; WBC31; B1961550; B1961481 |
| 0.9348 | 0.8966 | 0.9200 | B1961499; BM735096; B1961567; WBC041434; BM734900; BM734719; WBC041B04; B1961054; B1961481; B1961659 |
| 0.9348 | 0.8966 | 0.9200 | BM734607; WBC036C09; B1961469; WBC009D04; B1961054; WBC028D07; WBC030G08; B1961481; BM734862; BM735170 |
| 0.9130 | 0.9310 | 0.9200 | WBC028D07; B1961434; B1961481; BM735096; GI1305528; BM735054; BM735170; WBC041B04; B1961550; WBC009D04 |
| 0.9130 | 0.8966 | 0.9067 | BM735096; B1961499; BM734613; WBC048H02; WBC010C05; WBC032G11; WBC881; BM734900; WBC005G04; WBC041B04 |
| 0.9565 | 0.8276 | 0.9067 | BM735054; BM734607; BM734900; WBC881; BM735031; WBC007E09; WBC048H02; B1961054; WBC013G08 |
| 0.9348 | 0.8621 | 0.9067 | WBC024E03; BM734607; WBC020C09; WBC007E09; B1961481; WBC005G04; WBC031E09; B1961438; WBC009D04; GI1305528 |
| 0.9348 | 0.8621 | 0.9067 | BM735031; BM734607; BM734613; WBC012F12; WBC422; B1961054; WBC009D04; WBC022G05; B1961481; WBC030G08 |
| 0.8913 | 0.9310 | 0.9067 | WBC285; WBC041C11; BM781436; WBC009D04; B1961054; BM735096; B1961434; B1961481; B1961550; WBC028A02 |
| 0.9348 | 0.8621 | 0.9067 | BM734607; B1961434; BM734862; WBC041C11; BM734613; WBC009D04; BM735170; WBC028D07; B1961481; B1961567 |
| 0.9348 | 0.8621 | 0.9067 | B1961499; WBC422; WBC009D04; B1961434; WBC022G05; BM780886; WBC44; B1961434; WBC036C09; B1961481 |
| 0.9348 | 0.8621 | 0.9067 | WBC048H02; WBC036C09; BM735054; BM735096; B1961054; WBC31; BM734862; WBC010C05; WBC007E09; B1961434 |

TABLE 18-continued

TEN GENES SELECTED

| Sensitivity | Specificity | Success | Genes (10) |
|---|---|---|---|
| 0.9565 | 0.8276 | 0.9067 | WBC007E09; WBC005G04; BM735096; WBC041B04; B1961499; WBC009D04; B1961690; WBC422; WBC024E03; BM735031 |
| 0.9348 | 0.8621 | 0.9067 | B1961434; WBC029A01; WBC020C09; B1961581; BM734719; WBC005G04; BM781436; WBC007E09; B1961481; WBC009D04 |
| 0.9348 | 0.8621 | 0.9067 | BM735096; B1961438; WBC028D07; WBC44; Foe1268; WBC007E09; WBC028A02; WBC048H02; BM781127; WBC022G05 |
| 0.9130 | 0.8966 | 0.9067 | B1961481; BM735096; WBC048H02; B1961054; WBC012F12; BM734661; WBC881; BM735031; BM735054; GI1305528 |
| 0.9130 | 0.8966 | 0.9067 | BM735054; WBC31; WBC036C09; B1961481; WBC285; B1961550; B1961054; B1961581; BM734900; B1961434 |
| 0.8913 | 0.8966 | 0.8933 | B1961567; B1961481; WBC022G05; WBC028A02; B1961469; B1961054; WBC44; WBC881; BM735054; B1961581 |
| 0.9348 | 0.8276 | 0.8933 | WBC036C09; WBC035E08; WBC041C11; BM734719; B1961659; WBC031E09; B1961481; B1961581; WBC422; BM735096 |

TABLE 19

TWENTY GENES SELECTED

| Sensitivity | Specificity | Success | Genes (20) |
|---|---|---|---|
| 0.9130 | 0.8966 | 0.9067 | WBC020C09; B1961054; B1961434; WBC012F12; B1961550; WBC422; WBC021A01; WBC022G05; WBC010B02; BM735096; WBC31; WBC026C03; BM734661; B1961690; GI1305528; BM734719; WBC009D04; WBC028D07; WBC041B04; B1961481 |
| 0.9130 | 0.8966 | 0.9067 | BM735096; B1961054; BM735449; BM781436; WBC024E03; WBC010B02; B1961438; B1961567; WBC036C09; WBC004E01; WBC010C05; WBC881; BM734862; WBC032G11; WBC009D04; WBC016C12; B1961481; WBC007E09; Foe1268; BM780886 |
| 0.9130 | 0.8621 | 0.8933 | B1961054; WBC029A01; WBC004E01; B1961659; WBC036C09; BM734719; WBC035E08; BM781127; BM735096; WBC44; B1961690; WBC422; WBC016C12; WBC009D04; WBC026C03; B1961481; BM735170; BM781436; BM734661; WBC013G08 |
| 0.9348 | 0.8276 | 0.8933 | WBC021A01; BM734613; WBC009D04; WBC44; B1961438; BM780886; WBC024E03; WBC031E09; WBC020C09; WBC007A05; B1961550; WBC036C09; B1961659; WBC007E09; WBC030G08; B1961481; B1961054; Foe1268; WBC422; WBC024007 |
| 0.9130 | 0.8621 | 0.8933 | WBC031E09; WBC013G08; WBC041C11; WBC005G04; BM734613; WBC009D04; WBC028D07; WBC44; B1961434; BM780886; B1961550; BM781436; WBC029A01; B1961438; WBC024E03; BM734661; WBC31; B1961481; Foe1268; BM734900 |
| 0.9130 | 0.8621 | 0.8933 | BM735031; WBC007A05; BM735054; WBC021A01; B1961054; BM735449; BM734607; GI1305528; WBC016C12; B1961438; B1961481; WBC024E03; B1961567; B1961550; WBC009D04; WBC03SE08; WBC013G08; WBC032G11; WBC028A02; B1961434 |
| 0.8913 | 0.8966 | 0.8933 | WBC031E09; WBC016C12; WBC013G08; WBC035E08; WBC009D04; B1961054; Foe1268; WBC032G11; B1961567; WBC881; B1961690; WBC029A01; GI1305528; WBC022G05; BM735170; WBC010B02; BM735054; B1961481; WBC012F12; WBC021A01 |
| 0.9130 | 0.8621 | 0.8933 | WBC44; BM735096; WBC008B04; BM735449; WBC036C09; BM781436; B1961499; WBC285; B1961469; WBC032C03; Foe1268; WBC048H02; WBC028A02; WBC010C05; WBC009D04; WBC021A01; WBC026C03; WBC028D07; WBC010B02; WBC005G04 |
| 0.9348 | 0.8276 | 0.8933 | WBC041C11; B1961054; WBC44; WBC009D04; WBC028D07; WBC012F12; B1961567; WBC024D07; WBC024E03; B1961481; WBC013G08; GI1305528; BM781127; B1961438; WBC020C09; B1961581; WBC021A01; B1961469; Foe1268; BM735031 |
| 0.9130 | 0.8621 | 0.8933 | B1961659; WBC024D07; BM734719; B1961581; WBC31; B1961054; B1961499; WBC024E03; BM735170; WBC881; B1961469; B1961481; WBC031E09; BM735096; WBC009D04; WBC31; WBC028A02; WBC030G08; WBC012F12; WBC032C03 |
| 0.9130 | 0.8621 | 0.8933 | WBC028A02; WBC008B04; B1961690; WBC028D07; WBC022G05; WBC030G08; B1961438; BM734661; B1961499; BM781127; WBC031E09; BM781436; GI1305528; WBC013G08; WBC004E01; B1961054; WBC021A01; WBC041B04; BM735031; BM734719 |
| 0.9565 | 0.7931 | 0.8933 | B1961690; B1961481; WBC31; WBC024E03; BM734613; WBC007A05; BM734900; WBC026C03; BM735449; WBC041C11; WBC024D07; WBC007E09; WBC021A01; BM734719; WBC31; WBC041B04; B1961499; BM735170; WBC012F12; WBC028D07 |
| 0.9130 | 0.8621 | 0.8933 | B1961481; B1961434; B1961567; WBC44; WBC881; WBC028A02; WBC010B02; WBC048H02; B1961438; BM734862; WBC009D04; WBC035E08; WBC31; BM734607; BM735054; BM734900; BM734661; BM781127; WBC013G08; WBC031E09 |
| 0.9130 | 0.8621 | 0.8933 | WBC041B04; Foe1268; GI1305528; BM735054; WBC008B04; WBC009D04; WBC004E01; B1961481; WBC021A01; B1961054; BM735031; WBC007A05; WBC013G08; B1961499; B1961438; WBC31; WBC026C03; B1961469; WBC010C05; BM734661 |
| 0.9130 | 0.8621 | 0.8933 | WBC022G05; WBC008B04; B1961434; B1961438; B1961054; WBC032G11; WBC016C12; WBC007A05; B1961567; WBC031E09; BM735449; WBC31; WBC005G04; WBC041C11; WBC028D07; WBC032C03; WBC041B04; WBC009D04; WBC010B02; B1961481 |
| 0.9130 | 0.8621 | 0.8933 | WBC028D07; WBC010B02; WBC009D04; BM735449; BM734719; BM734862; BM735096; BM781436; B1961550; WBC008B04; BM734607; WBC016C12; WBC024E03; Foe1268; B1961438; BM781127; BM734613; B1961054; B1961481; WBC44 |

TABLE 19-continued

TWENTY GENES SELECTED

| Sensitivity | Specificity | Success | Genes (20) |
|---|---|---|---|
| 0.8913 | 0.8966 | 0.8933 | B1961054; WBC041C11; WBC009D04; BM734661; WBC032C03; BM734719; WBC031E09; BM734607; BM735031; B1961550; B1961438; BM735449; WBC021A01; BM735054; BM781436; WBC028D07; B1961434; B1961581; WBC016C12; GI1305528 |
| 0.9130 | 0.8621 | 0.8933 | BM735449; WBC041B04; BM735031; BM735054; WBC007A05; WBC024E03; WBC016C12; WBC010C05; WBC022G05; WBC013G08; WBC422; B1961499; BM780886; WBC004E01; WBC012F12; BM781436; WBC007E09; GI1305528; BM735096; B1961567 |
| 0.9130 | 0.8621 | 0.8933 | BM735031; WBC024D07; B1961054; B1961481; BM734862; BM734900; BM735170; B1961690; WBC004E01; BM781127; WBC881; B1961434; B1961659; WBC022G05; WBC44; WBC032C03; BM780886; WBC009D04; B1961499; WBC035E08 |
| 0.9130 | 0.8621 | 0.8933 | B1961567; BM735170; BM734900; WBC881; WBC041B04; WBC009D04; WBC016C12; WBC048H02; B1961481; B1961054; BM734613; B1961659; BM734719; BM781436; WBC030G08; WBC024D07; WBC31; B1961581; WBC026C03; WBC422 |

TABLE 20

THIRTY GENES SELECTED

| Sensitivity | Specificity | Success | Genes (30) |
|---|---|---|---|
| 0.9130 | 0.8276 | 0.8800 | WBC012F12; BM781127; BM735449; BM734862; WBC007A05; WBC31; BM734900; WBC009D04; WBC041B04; B1961438; WBC032C03; B1961054; B1961434; WBC016C12; B1961481; B1961550; WBC024E03; WBC028D07; WBC022G05; BM734719; WBC005G04; WBC024D07; BM781436; WBC028A02; Foe1268; WBC010C05; WBC881; B1961659; WBC004E01; WBC048H02 |
| 0.9348 | 0.7931 | 0.8800 | BM734661; B1961499; WBC005G04; BM735449; WBC44; B1961550; B1961581; WBC032C03; BM781436; BM734900; WBC036C09; BM781127; WBC035E08; WBC285; BM734607; B1961690; WBC007E09; WBC029A01; BM734613; WBC008B04; WBC048H02; WBC030G08; BM735096; WBC881; WBC009D04; BM734862; BM735031; WBC041B04; WBC026C03; BM735170 |
| 0.8913 | 0.8621 | 0.8800 | WBC028A02; WBC032C03; WBC44; WBC005G04; BM735031; WBC028D07; WBC31; WBC009D04; WBC016C12; B1961481; BM780886; WBC048H02; BM735170; WBC31; WBC041B04; B1961438; BM735449; B1961690; B1961659; WBC012F12; B1961581; WBC035E08; BM734719; WBC010B02; B1961499; GI1305528; BM734607; WBC036C09; BM735096; WBC021A01 |
| 0.9130 | 0.8276 | 0.8800 | WBC007E09; WBC44; BM734900; WBC035E08; WBC024E03; WBC009D04; BM734613; WBC041C11; WBC285; BM781127; BM734719; B1961581; WBC031E09; WBC032C03; WBC005G04; WBC036C09; WBC010C05; BM734862; BM735449; BM735096; B1961469; WBC020C09; WBC041B04; WBC008B04; BM781436; WBC028D07; B1961659; BM735031; GI1305528; B1961481 |
| 0.8913 | 0.8621 | 0.8800 | WBC036C09; B1961438; BM735170; BM734862; WBC029A01; B1961659; WBC285; B1961550; WBC016C12; WBC007E09; B1961434; WBC028A02; BM735096; BM734719; WBC035E08; WBC010C05; B1961567; BM735031; WBC007A05; B1961581; BM735054; WBC031E09; BM734900; WBC026C03; B1961054; GI1305528; WBC009D04; B1961481; WBC048H02 |
| 0.8696 | 0.8966 | 0.8800 | WBC009D04; WBC010B02; WBC031E09; Foe1268; WBC422; B1961438; WBC881; WBC31; WBC285; BM734613; BM735054; B1961054; BM734900; BM781436; WBC024E03; WBC007A05; B1961499; B1961567; WBC041C11; BM735449; B1961434; WBC028D07; WBC012F12; WBC008B04; BM734661; WBC016C12; WBC041B04; WBC007E09; B1961481; WBC024D07 |
| 0.8913 | 0.8621 | 0.8800 | WBC016C12; WBC007E09; BM734719; WBC020C09; WBC024D07; B1961499; B1961659; WBC030G08; WBC422; WBC881; WBC044; BM734900; BM735449; BM734613; BM735054; BM734661; WBC005G04; BM735096; B1961550; WBC036C09; GI1305528; WBC012F12; WBC026C03; BM734862; WBC032G11; WBC010B02; WBC032C03; BM734607; B1961054; WBC022G05; B1961469 |
| 0.8696 | 0.8621 | 0.8667 | BM781436; WBC032G11; WBC009D04; B1961434; BM735054; B1961567; WBC881; WBC008B04; WBC024D07; BM734719; WBC007E09; WBC035E08; WBC041B04; BM734607; WBC031E09; B1961690; WBC022G05; B1961481; GI1305528; BM735096; B1961054; WBC007A05; WBC020C09; BM735449; WBC048H02; WBC028A02; B1961469; WBC004E01; BM781127; WBC010B02 |
| 0.8913 | 0.8276 | 0.8667 | WBC028A02; BM734613; BM734862; WBC007A05; WBC029A01; WBC004E01; BM735054; BM780886; WBC016C12; BM734900; WBC024D07; WBC028D07; BM734719; BM735170; WBC010B02; B1961434; B1961481; BM734607; WBC021A01; WBC026C03; BM781436; B1961659; WBC009D04; B1961438; B1961054; BM735449; WBC881; WBC036C09; WBC422; WBC005G04 |
| 0.9130 | 0.7931 | 0.8667 | WBC035E08; WBC036C09; B1961438; B1961481; BM781436; BM734661; WBC285; BM734607; WBC010B02; BM734900; WBC026C03; WBC005G04; B1961659; B1961469; WBC881; WBC028D07; BM734719; B1961581; WBC028A02; BM735449; WBC024E03; WBC007E09; WBC31; GI1305528; BM734613; WBC008B04; B1961054; WBC032G11; WBC422; WBC032C03 |
| 0.8913 | 0.8276 | 0.8667 | WBC041B04; WBC007A05; WBC032G11; BM734719; WBC44; WBC31; WBC010B02; B1961434; WBC028A02; B1961438; B1961659; WBC881; BM735096; BM781127; WBC012F12; WBC030G08; B1961567; B1961690; B1961499; WBC021A01; WBC005G04; BM735054; B1961434; WBC035E08; WBC032D03; B1961054; B1961469; WBC008B04; GI1305528; BM781436 |
| 0.8696 | 0.8621 | 0.8667 | WBC030G08; WBC44; WBC31; WBC024E03; B1961550; Foe1268; BM734719; WBC881; WBC022G05; WBC005G04; B1961499; WBC029A01; WBC032C03; WBC007A05; WBC021A01; WBC024D07; B1961481; WBC285; WBC012F12; WBC028A02; WBC010B02; BM781127; WBC422; B1961054; WBC009D04; BM735449; WBC028D07; GI1305528; BM734661; B1961469 |
| 0.8696 | 0.8621 | 0.8667 | WBC007A05; GI1305528; B1961481; B1961567; WBC881; WBC010B02; WBC048H02; BM734862; WBC422; WBC031E09; WBC022G05; WBC007E09; WBC030G08; BM735096; WBC008B04; BM735054; WBC44; WBC004E01; WBC041C11; WBC035E08; BM780886; BM781127; BM781436; B1961054; B1961690; WBC032C03; WBC024D07; B1961659; WBC005G04; BM734719 |

TABLE 20-continued

THIRTY GENES SELECTED

| Sensitivity | Specificity | Success | Genes (30) |
|---|---|---|---|
| 0.8696 | 0.8621 | 0.8667 | BI961054; WBC024E03; WBC010B02; WBC026C03; BI961690; BM781436; WBC31; BM780886; WBC31; GI1305528; BM735449; WBC041C11; WBC004E01; BI961481; WBC881; WBC285; WBC035E08; WBC007E09; WBC028A02; WBC005G04; WBC029A01; WBC041B04; BI961659; BM735031; WBC007A05; BM734719; WBC032C03; BI961567; BM734661; BM734862 |
| 0.9130 | 0.7931 | 0.8667 | GI1305528; BM734607; BM735170; WBC008B04; Foe1268; WBC285; BM734613; WBC024E03; BM781436; BI961581; BM734719; WBC009D04; BI961054; BI961659; WBC028D07; WBC31; BI961567; BI961481; WBC032G11; WBC020C09; WBC010C05; BI961550; WBC031E09; BM735096; WBC004E01; WBC026C03; BM734661; BM781127; BI961469; BI961499 |
| 0.8913 | 0.8276 | 0.8667 | WBC016C12; BM781127; WBC024E03; BI961567; WBC041B04; WBC009D04; WBC007A05; BI961550; WBC041C11; BI961690; WBC010C05; BM735449; BM735096; BI961499; BI961581; WBC881; BI961054; BM781436; WBC032G11; BI961469; WBC010B02; BM735054; WBC020C09; WBC021A01; WBC031E09; BI961481; BI961434; BM734661; WBC285; WBC013G08 |
| 0.8478 | 0.8966 | 0.8667 | BM781436; WBC026C03; BI961690; WBC031E09; WBC009D04; BM735170; WBC44; BI961434; WBC022G05; BM735054; BI961499; WBC029A01; WBC041C11; WBC016C12; BI961567; WBC024E03; BI961054; WBC004E01; WBC31; BI961481; BI961469; BM734719; WBC032C03; WBC012F12; WBC008B04; WBC028A02; WBC041B04; BM734900; BM734661; WBC005G04 |
| 0.8696 | 0.8621 | 0.8667 | WBC028D07; BM734900; WBC032C03; WBC010D02; WBC012F12; BM780886; WBC007E09; BM781127; WBC009D04; WBC31; BM735096; WBC022G05; BI961469; BM735031; BM735054; BI961499; GI1305528; BM735449; WBC020C09; WBC007A05; WBC021A01; WBC041B04; WBC026C03; BI961434; BI961054; BI961690; WBC028A02; WBC035E08; WBC285; BI961438 |
| 0.8913 | 0.8276 | 0.8667 | WBC032C03; WBC029A01; BM781436; WBC31; WBC44; GI1305528; BI961481; WBC024D07; WBC028D07; BI961659; WBC026C03; WBC008B04; BM734900; BM780886; BM734719; WBC036C09; BI961438; WBC007E09; WBC041B04; WBC009D04; BM735096; BM734607; WBC004E01; BM781127; WBC020C09; WBC010B02; WBC422; BI961054; BM734661; WBC035054 |
| 0.9130 | 0.7931 | 0.8667 | Foe1268; WBC010B02; WBC032G11; BM735170; WBC022G05; WBC31; WBC030G08; BM734900; BM781127; BM781436; WBC041B04; BM734719; BM780886; BM734613; BM734862; WBC422; WBC029A01; WBC012F12; GI1305528; WBC021A01; BI961481; BI961469; BI961054; BI961581; WBC44; WBC009D04; WBC032C03; BI961438; WBC024D07; WBC013G08 |

TABLE 21

GENE ONTOLOGY

| Gene | GenBank Homology | Uniprot | Component | Function | Process |
|---|---|---|---|---|---|
| BI961481.V1.3__AT | No Homology | NA | NA | NA | NA |
| WBC026C03_V1.3__AT | *Homo sapiens* interferon, gamma-inducible protein 16, mRNA. | Q16666 | Nucleus | DNA binding and transcription repression | Response to virus, immune response |
| WBC005G04_V1.3__AT | *H. sapiens* myeloid cell nuclear differentiation antigen mRNA, complete cds. | P41218 | Nucleus | DNA binding | Immune response |
| WBC020C09_V1.3__AT | No Homology | NA | NA | NA | NA |
| WBC007A05_V1.3__AT | *Homo sapiens* G protein-coupled receptor 65, mRNA | Q8IYL9 | Integral to plasma membrane | Receptor and signal transduction activity | Immune response |
| BI961581 | *Homo sapiens* NAD kinase ACCESSION BC001709 | O95544 | Cytosol | NAD+ kinase activity | ATP metabolism |
| BH735170.V1.3__AT | No Homology | NA | NA | NA | NA |
| WBC010C05 | *Bos taurus* similar to hypothetical protein BC012928 (LOC529385) | NA | NA | NA | NA |
| WBC009D04_V1.3__AT | Human mRNA of X-CGD gene involved in chronic granulomatous disease located on chromosome X. | P04839 | Integral to membrane | Metal binding, oxidoreductase activity | Inflammatory response, electron transport |
| BI961434.V1.3__AT/ BI961054.V1.3__AT BI961434.V1.3__S_AT | IP-10 mRNA for interferon-gamma-inducible protein-10 | P02778 | Extracellular | Chemokine activity | Immune response |
| BM780886.V1.3__AT | HOMO SAPIENS 6-PHOSPHOGLUCONOLACTONASE, MRNA (CDNA CLONE MGC: 20013 IMAGE: 4053022). | O59479 | Endoplasmic reticulum | 6-phosphogluconolactonase activity | Carbohydrate activity |
| WBC004E01_V1.3__AT | *Homo sapiens* Apo-2 ligand mRNA, complete cds | P50591 | Integral to membrane | TNF receptor binding | Immune response |
| BI961659.V1.3__AT | No Homology | NA | NA | NA | NA |
| WBC008B04 | No homology | NA | NA | NA | NA |
| BM735449.V1.3__AT | No Homology | NA | NA | NA | NA |
| WBC029A01 | *Homo sapiens* programmed cell death 10 (PDCD10), transcript variant 3 | Q9BUL8 | NA | NA | NA |

TABLE 21-continued

GENE ONTOLOGY

| Gene | GenBank Homology | Uniprot | Component | Function | Process |
|---|---|---|---|---|---|
| BM781436.V1.3_AT | *Homo sapiens* SH3 domain binding glutamic acid-rich protein like 3, mRNA | Q9H299 | Nucleus | NA | NA |
| BM735054.V1.3_AT | *Homo sapiens* family with sequence similarity 14, member A, mRNA (cDNA clone MGC: 44913 IMAGE: 5229498). | X9H2X8 | Integral to membrane | NA | Response to pest, parasite or pathogen |
| WBC31 | No homology | NA | NA | NA | NA |
| BM734900 | *Homo sapiens* matrix metalloproteinase 9 (gelatinase B, 92 kDa gelatinase, 92 kDa type IV collagenase), mRNA (cDNA clone MGC: 12688 IMAGE: 4054882) | P14780 | Extracellular | Ion binding, metallopeptidase activity | Proteolysis |
| B1961438 | No homology | NA | NA | NA | NA |
| B1961550.V1.3_AT | *Homo sapiens* cDNA FLJ40597 fis, clone THYMU2011118 | NA | NA | NA | NA |
| BM734862.V1.3_AT | *Homo sapiens* triggering receptor expressed on myeloid cells 1, mRNA | Q9NP99 | Integral to membrane | Receptor activity | Humoral response |
| WBC041B04_V1.3_AT | Human mRNA for 56-KDa protein induced by interferon. Also called IFIT-1 | P09914 | Cytoplasm | Binding | Immune response |
| WBC422.GRSP.V1.3_AT | *Homo sapiens* guanylate binding protein 5, mRNA. | Q96PP8 | NA | GTP binding | Immune response |
| WBC007E09 | *Homo sapiens* sterol-C5-desaturase (ERG3 delta-5-desaturase homolog, fungal)-like, transcript variant 2 (SC5DL) | Q6GTM5 | Integral to membrane | Oxidoreductase activity | Lipid metabolism |
| BM735031.V1.3_AT | *Homo sapiens* N-myc (and STAT) interactor, mRNA (cDNA clone MGC: 5050 IMAGE: 3452659). | Q13287 | Cytoplasm | Transcription cofactor activity | Inflammatory response |
| WBC013G08_V1.3_AT | *Homo sapiens* cDNA FLJ16386 fis, clone TRACH2000862, moderately similar to Mus musculus putative purine nucleotide binding protein mRNA | NA | NA | NA | NA |
| BM735096 | *Homo sapiens* CD79A antigen (immunoglobulin-associated alpha) (CD79A), transcript variant 1 | P11912 | Integral to membrane | Transmembrane receptor activity | Defence response |
| GI1305528.V1.3_AT | *Equus caballus* Mx protein homolog mRNA. | P27594 | NA | GTP binding | Immune response |
| WBC881.GRSP.V1.3_AT | *Homo sapiens* makorin, ring finger protein, 1, mRNA (MKRN1) | Q9UHC7 | Ubiquitin ligase complex | Ubiquitin-protein ligase binding activity | Protein ubiquitination |
| WBC44.V1.3_AT | *Homo sapiens* B aggressive lymphoma gene, mRNA. | Q8IXQ6 | Nucleus | NAD+ ADP-ribosyltransferase activity | Cell migration |
| WBC041C11 | *Homo sapiens* copine I (CPNE1) | Q99829 | NA | Transporter activity | Vesicle mediated transport |
| WBC036C09_V1.3_AT | *Homo sapiens* delta sleep inducing peptide, immunoreactor, mRNA. | NA | NA | NA | NA |
| WBC285 | No homology | NA | NA | NA | NA |
| WBC030G08_V1.3_AT | *Homo sapiens* chromosome 6 open reading frame 72, mRNA. | NA | NA | NA | NA |
| WBC024D07 | *Homo sapiens* heat shock 70 kDa protein 8, transcript variant 1 (HSPA8) | P11142 | Cell surface, nucleus | ATP binding | Protein folding |
| WBC031E09_V1.3_AT | Human EV12 protein gene, exon 1. | NA | NA | NA | NA |
| BM734613 | *Homo sapiens* presenilin-associated protein mRNA. | Q9UJZ5 | Integral to membrane, mitochondrial | Protein binding | Transport |
| WBC012F12_V1.3_AT | No Homology | NA | NA | NA | NA |
| BM734661 | Human UbA52 adrenal mRNA for ubiquitin-52 amino acid fusion protein. | P62987 | Nucleus, ribosome | Protein modification | Structural component of ribosome |
| WBC022G05 | *Homo sapiens* ELOVL family member 5, elongation of long chain fatty acids (FEN1/Elo2, SUR4/Elo3-like, yeast) (ELOVL5) | Q7L2S5 | NA | NA | NA |
| WBC032G11_V1.3_AT | *Homo sapiens* cDNA FLJ20073 fis, clone COL02320. | NA | NA | NA | NA |
| WBC028A02 | No homology | NA | NA | NA | NA |
| WBC024E03_V1.3_AT | *Homo sapiens* transcription factor ISGF-3 mRNA. | Q00978 | Cytoplasm, nucleus | Transcription factor | Immune response |

TABLE 21-continued

GENE ONTOLOGY

| Gene | GenBank Homology | Uniprot | Component | Function | Process |
|---|---|---|---|---|---|
| BM734607.V1.3_AT | *H. sapiens* mRNA for XIAP associated factor-1 (BIRC4BP). | Q6GPH4 | NA | Zinc ion binding | NA |
| Foe1268 | Myo-inositol 1-phosphate synthase A1 (ISYNA1) | Q9NPH2 | NA | Inositol-3-phosphate synthase activity | Inositol biosynthesis |
| WBC035E08 | *Homo sapiens* ubiquitin-conjugating enzyme E2D 1 (UBC4/5 homolog | P51668 | NA | Ligase activity | Ubiquitin cycle |
| BM734719.V1.3_AT | No Homology | NA | NA | NA | NA |
| BM781127.V1.3_AT | *Homo sapiens* acid phosphatase 5, tartrate resistant (ACP5), mRNA. | P13686 | NA | Integral to membrane, lysosome | Hydrolase activity |
| WBC048H02.bFSP_20021501.esd | *Homo sapiens* guanine nucleotide binding protein (G protein), beta polypeptide 2-like 1 (GNB2L1), mRNA. | Q6RW13 | NA | NA | Receptor activity |
| B1961469 | No homology | NA | NA | NA | NA |
| WBC021A01 | No homology | NA | NA | NA | NA |
| B1961499 | *Homo sapiens* SUI1 isolog (also eIF1) | P41567 | Cytoplasm | Translation initiation activity | Protein biosynthesis |
| B1961690.V1.3_AT | *Homo sapiens* eukaryotic translation initiation factor 3, subunit 5 epsilon, 47 kDa mRNA. (EIF3S5) | O00303 | Eukaryotic translation initiation factor 3 complex | Translation initiation activity | Protein biosynthesis |
| WBC016C12 | No homology | NA | NA | NA | NA |
| WBC032C03 | No homology | NA | NA | NA | NA |
| WBC028D07_V1.3_AT | Human guanylate binding protein isoform II (GBP-2) mRNA | P32456 | NA | GTP binding | Immune response |
| WBC010B02_V1.3_AT | *Homo sapiens* C-type lectin protein CLL-1 mRNA, complete cds. | Q5QGZ9 | NA | Sugar binding | NA |
| B1961567.V1.3_AT | *Homo sapiens* leucine aminopeptidase 3, mRNA. | P28838 | Cytoplasm | Amino peptidase activity | Proteolysis |

SEQUENCE LISTING (2150 sequences)

SEQ ID NO: 1 - DNA, 359 bp, equine
actgacagttgaaacgatcaatggaatgatcagcacaaacagaaaatattactgttactgtaatattatgtgatatcctctatatctaagatatatattatatatatgatgtaagataagatatatattaaatatataatgtaatatatattatataacatgtactctctctatatatacatatgtatcacgtaatgtatatatataatgtaatataatattgctgttactggaaagatgaccgcaagaagttgattttttatctaccagaagttttcttcgctgtgttttaagtcggcgatctgctttgatcgttttgttcgcttctgctgtttgagaagaacgattgaaaggagcca

SEQ ID NO: 2 - DNA, 2709 bp, equine
  CDS (258)..(2381)
gcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcaggtgccaccaccaaccccatccagcagttccttaatcaagaagaaaccaagattgaaggctgtacctaaagaagcttccaaagaagagggtctacagacggaccccaaagaagtgatggtactgaaggcaacagaaccatttgcatatgagcccaaagagcagaagaaaatgttccatgccacagtggctactgagagccagttcttccgagtgaaggtttttgatgtcagtctgaagcagaagttcatcccaaagaaaatcattgccatatcagattatattggccgcaatgggttcctggaggtgtacagtgcctcatctgtgtctgatgttaatgctgaccgaaagatggaggtctcaaaaagactgattgcaaatgcaaatgcaactcctaaaatcaatcatctgtgctcacaagctccaggaacatttgtgaatggggtgtatgaggtgcataagaaaatagtgtggaatgatttcatatattatgaaatacaagatgatacagggaagatggaagtcatggtgtatggacgactgaccaaaatcaactgcgaggaaagagataaacttcaactcatctgctttgaattggcaccgaaaagtgggaataccggggagttgagatctgtaattcacagtttcatcaaggtcatcaaggccaggtaaagcaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaaaaaaaaaaaaa

SEQ ID NO: 3 - protein, 708 aa, equine
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKKSEDTISKMNDFMRMQILKEGSHFPGPFMTSIGPAESHPHTPQVPPPTPSSSSLIKKKPRLKAVPKEASKEEGLQTDPKEVMVLKATEPFAYEPKEQKKMFHATVATESQFFRVKVFDVSLKQKFIPKKIIAISDYIGRNGFLEVYSASSVSDVNADRKMEVSKRLIANANATPKINHLCSQAPGTFVNGVYEVHKKIVWNDFIYYEIQDDTGKMEVMVYGRLTKINCEERDKLQLICFELAPKSGNTGELRSVIHSFIKVIKAR

SEQ ID NO: 4 - DNA, 1676 bp, equine
  CDS (201)..(1427)
attgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattactatatcagattactttgaatgtaaaggaatcctggaggtaaatgaagcatcatctgtatctgaagctggtattgatccaaagattgaggtccctaccagaattatcaaaagagcaaatcaaactcccaagattgataatcttcacaaacaagcatcgggaacatttgtttatgggttgtttgtgttacatcagaaaaaagtgaataacaagaacacgatctatgaaatagaggataaaacaggaaagatggatgtagtggggaatggaaaatggcacaatatcaagtgtgaggaaggagataaacttcgactcttctgctttcaattgagaacacttgacaagaggctgaaactgacatgtggaaatcacagtttcattcaggtcatcaaggctaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaaccg

SEQ ID NO: 5 - protein, 409 aa, equine
MVNEYKKILLLKGFELMDDYHFTSIKSLLAYDLGLTTKMQEEYNRIKITDLMEKKFQGVACLDKLIELAKDMPSLKNLVNNLRKEKSKVAKKIKTQEKAPVKKINQEEVGLAAPAPTARNKLTSEARGRIPVAQKRKTPNKEKTEAKRNKVSQEQSKPPGPSGASTSAAVDHPPLPQTSSSTPSNTSFTPNQETQAQRQVDARRNVPQNDPVTVVVLKATAPFKYESPENGKSTMFHATVASKTQYFHVKVFDINLKEKFVRKKVITISDYFECKGILEVNEASSVSEAGIDPKIEVPTRIIKRANQTPKIDNLHKQASGTFVYGLFVLHQKKVNNKNTIYEIEDKTGKMDVVGNGKWHNIKCEEGDKLRLFCFQLRTLDKRLKLTCGNHSFIQVIKAKKNKEGPMNVN

SEQ ID NO: 6 - DNA, 920 bp, equine
tcatgatcctgggacaatgaggagctgggaacagtggtaggaaccacggcagtgtaccggtaggcctgactcagtcactggtcctcaacctttagtgcctatgaaatgagcctctggtgagccctgctttgcctgactcaaggtagcactgaggatcacagaggtaatcttcataaaggtctcgtcaggcttccttcagagcttcaccatgaggcaggttaggagcaggctcctgctggcccagaggagacctagagtcacaacccaggccccacactccctcacccacttgcttgctctctgagcagggcagctaccaccacccctctcaacctgggttctgccttagagggcagagtttgcttcactcatctggtttccacaaggcctgcaagataggagttgtagtctttgctgtaaaaaactgaggctcaaagaggtgaagcgacttgcccaagggcacacagctggtaagtagcatacctgaggtgtatctaactccaaagcctacattgtttaatgactatggagatgcttcctagaaccatggtccagattctacctcaaattctgctgctgccttctccctgatggtttaaaatgactgattagtgctactgagtccccatttaggaagaaaaccttaagctaatatggtgctttgaatggtggaatccaagcaatatggaaaatatgggggccttttctggcacctctgaagtcactccacaaaagtggccacctcctgtcaagcttggacctatcacagcccaaacctagactcaaatgtggggagtctcccctggcacaggagaggtgcctgacacaccgttgttggctgatggtaggcaacaggaagcaaatgtggtctgcacaggcccagctgggcctagaggcagggactcccacaggccacggtg

SEQ ID NO: 7 - DNA, 523 bp, equine
gcacagacaagggacttaaggctggcgagggagaaaccaaagccattccagcatgtgtgtcctttgtgctgcctctaatctaagctgggtgagtttgtgggaagcgaccctcgagattctgatgacagttttgccactgagccgtgtgaggcctgggacaagtattttcttctctgcttcagttttcctgagtacagtgtcaccatatcacactagagacagccccttgtaaagatcgtgtgttatgagaaatcagcagagctggggaccctcaggctacacagcactgccccgtgctatcacagtgggagcacagaggctctgaaccctcagggacccggccatgcccacaaagccaggacagggacccaagtccttggctacttgggccctgcccttccctctgctccacagaagggctacatgatgctcctctgcctcccacacacactctcctgggtgtagctggaggacaggaaataaatctttattgcgtcagtttaaaaaaaaaaaaaaaaaaaaa

SEQ ID NO: 8 - DNA, 1787 bp, equine
  CDS (531)..(1541)
ttcttgacttgatgcaggcacagatttatcaagctcctcagtcaacaaacacatcaccggaagaaacatggaaggaaaggaattttaaaaagagatgtcaatctctgtaaaaataaagccttatgtattcatgtttgcactaatctactgtgagatttatgaagaaaaacaaattgcggacaactctctatgtacacttacaaatgcctcagttgatgcttgtgggctgtttgtcagcattctgtgacaatgagcgcatggacttcagctcattaaaatcgactgaccactttagctaacagccaggagcctggattctgacttccaaccatcgatatctgtgtgaaaattgatctacacccaccctttaaaagcattgatgaattaataagaacttttgaaaacaaagaaaaatggaataaatcttagtaaaagagaattgaatgttgaaaacaaactacaacgaggcaagacttactttgctatttatcctctaagaacagatgtaattgctaccttaaaaagaaaagatgaacagcacatgtattgaagaacagcatgacctggatcactatttgtttccgattgtctacgtcattgtggtcatagtcagcattccagccaatattggatctctctgtgtgtcttttctgcaagtaaaaaaggaaaatgaattgggaatttacctcttcagtttatcactgtcagatctgctgtatacattaactctccctctatggattgattatacttggaataaagacaactggactttctctcctgccttgtgcaaagggagtgcttttctcatgtacatgaatttttacagcagcacagcattcctcacctgcattgccgttgatcggtatttggctgttgtctaccctttgaagttttttttcctaaggacaagaagatttgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgtttagaacgtgtgcatgctatgccatacctctggtcatcataatggtttgcaacctgaaggtctaccaagctgtgcagcataatcgagccacggaagacagtgaaaagaagagaatcataaaactacttgttagtatcacattgacttttatcttgtgttttactccctttcatgtgatgttgctgattcgctgcattctagagcatgctgtgaacttcgaagaccacagcaattctgggaagcgaacttacacaatgtatagaatcacggttgctttaacaagcttaaattgtgttgcggatccaattctgtactgttttgtgactgaaacaggaagatctgatatgtggaatgtactaaaattctgtactgggaggctcaacacatcacaaagacaaagaaaacgcataccgtctatgtctacaaaagatactgtagaattagaggtccttgagtagaaccaaggatgttttgaagggaagggaagtttaagttatgcattattatatcaccaagattgcgttttgaaaaggaaatctagcatgtgaggggactaagtgttctcagagtgatgttttaatccagtccaataaaaatatcttaaaactgcattgtacagctccctccctgcgttttattaaatgatgtatattaaacaaagatcaataaaaaaaaaaaaaaaaaaaaaaaaaaaaaaaaaa

SEQ ID NO: 9 - protein, 337 aa, equine
MNSTCIEEQHDLDHYLFPIVYVIVVIVSIPANIGSLCVSFLQVKKENELGIYLFSLSLSDLLYTLTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCACYAIPLVIIMVCNLKVYQAVQHNRATEDSEKKRIIKLLVSITLTFILCFTPFHVMLLIRCILEHAVNFEDHSNSGKRTYTMYRITVALTSLNCVADPILYCFVTETGRSDMWNVLKFCTGRLNTSQRQRKRIPSMSTKDTVELEVLE

SEQ ID NO: 10 - DNA, 3140 bp, equine
  CDS (86)..(1423)
gtagacgtggcgggcggacccgggggcgccctccggacgcggcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaaaggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagttgtctgccattcaatgtttacatttatgttctgcaagacgctgtcctcagggaccattaggggaccattctgttcagtgcgaccctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaaaaaaaaaaaaaaaaaaaaaaaaaaaaaaaaaaaaaaaaaaaaaaa

SEQ ID NO: 11 - protein, 446 aa, equine [sequence omitted]

SEQ ID NO: 12 - DNA, 454 bp, equine
tcgtcctcactgtttttaccttgacttcaactgcccacccattcagctgagcagctggggatgactggtttttttctgtcattatttacatatatttgctggagctgattactgaactcgtatttaatctctattgccagtgaaatgttacattatttttctgattggtttcccctcttattggaagtataattccagcaatgttagtaggatagaaaaggagggaatcatttgaggctttcaggttagcaagagctatgggcgttacatgcttgttttttccaagcagctaatttttatctacttctcagattaggtttgggggagctttggcatctttttagattttaatctctattttcttaatccagggtacaaatgtgagcaaaagaaaaaaagaaatcttttatacttttttaaataaatttataaataaattttgagctgcttcggt

SEQ ID NO: 13 - DNA, 774 bp, equine
  CDS (1)..(771)
atttctgctcctaatgaatttgatcttatgttcacactggaggttccccgaattcagctggaagaatattgccacaatactgatgtcattatggagaggaagaaaagagggagccctgctgtaacacttctgattagaaaacctagagaaatatctgtggatataatcctggctttggagtcaaaaagcagctggcctgctagcacccagaaaggcctgcccatcagtaactggcttggaacaaaagttaaggacaatctaaaacgacagccattttacctggtacccaagcacgcaaaggaaggaagtcttttccaagaagaaacatggcggctgtccttctctcacattgaaaaggccattttgacaaatcatggacaaactaaaacatgctgtgaaactgaaggagtaaaatgttgcaggaaagagtgtttaaagctgatgaaataccttttagaacaactgaaaaaaaagtttggaaagcaaaggggactggataagttctgttcttatcatgtgaagactgccttccttcatgtctgtacccagaacccgcatgacagttggtggctctacaaagacctggagctctgctttgataactgtgtgacatactttcttcagtgtctcaagacagaacaccttgagcactatttcattcctgatgtcaatctcttctctcgagacgaaattggcaagccaagtaaagaatttctgtcaaagcaaattgaatatgagcaaaacaatggatttccggtttttgatgagttttga

SEQ ID NO: 14 - protein, 257 aa, equine
ISAPNEFDLMFTLEVPRIQLEEYCHNTDVIMERKKRGSPAVTLLIRKPREISVDIILALESKSSWPASTQKGLPISNWLGTKVKDNLKRQPFYLVPKHAKEGSLFQEETWRLSFSHIEKAILTNHGQTKTCCETEGVKCCRKECLKLMKYLLEQLKKKFGKQRGLDKFCSYHVKTAFLHVCTQNPHDSWWLYKDLELCFDNCVTYFLQCLKTEHLEHYFIPDVNLFSRDEIGKPSKEFLSKQIEYEQNNGFPVFDEF

SEQ ID NO: 15 - DNA, 4267 bp, equine
  CDS (208)..(1725)
cttcctctgccaccatcggggaactgggctgtgaatgaggggctctccatttttgctattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccatgcaatgccagggtagaattaatttaaggccttaaagagaaatatctaaggaaataacttctgttactcttacagaccaaaggaacccgattcttctgacagtagagaacaggctaaagatagtaaccaataggatgtcctggaggttccctcacattcttgtttgaagcatggaggaaagggagatggaggcagagaatggacctcctaccataactggctggctcctctagtcctgctccccgtgccatgaaagaaatgcaaactgatttactgcctgaaagggtctcctccagccagcacttgtgaatttgaaattaagaattgtgacaaatatgtgtctgatatgcccatctgctttaaatagcatccaccccttgttttacttaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcttatttctgggaactataaacagatttgttggccccaccctctggaaccacagatatttagagctatttaaatttggtaatgcggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatactgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttatagacacttaggtccagcctgttcacactgcacctcgagtatcagttcattcattcaacaaatttttattgtgctgttaccatgactcacgctctgtttattgtttcaattctttacaccaaagtatgaactggagagggtacctcagttataaggagcctgagaatcttggtccctccaacctatgtggcccaagtaaaaccaactccatttgttgctctgaaaatgtttctccagggttttctatcttcaaaaccaactaagttatgaaagtagagagatctgccctgtgttatccagttatgagataaaaaatgagtataaaagtgcttgtcattataaaagtttcctttttatctctcaagccaccagctgccagccaccacgagccagctgccagcctagctttttttttttttttttttttagcacttagcatttagcatttagtaacaggtactgagagaacgattaagcattgtttttaatctcaaggctatgaaggctttttttagttctcctgcttttgcaatattgcgtttatgaaatttgaatgcttgtaggtgttgtgtgtgaataattttggggggcctgggagatattcctaggaagaactattaaaattgtgctcaactattaaaatgaatgagctttc

SEQ ID NO: 16 - protein, 506 aa, equine
MLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 17 - DNA, 1068 bp, equine
  CDS (7)..(312)
agcaccatgaacacaagtggttttcttattttctgccttatccttctgactctgagtcaaggcatacctctctctaggaatacacgctgtacctgcatcgagatcagtaatggatctgttaatccaaggtccttagaaaaacttgaactgattcctgcaagtcaatcctgcccacgtgttgagatcattgccacaatgaaaaagaatggggagaaaagatgtctgaatccagagtccaagaccgtcaagaatttactgaaagcaattagcaagcaaaggtctaaaagatctcctcgaacactgagagaagtataattacggtactactgataggatggcccagagagaggccgcctctgccatcatttccctgcatacagtatatgtcaagccctaattgtccccggattgcagttctcctaaaagatgaccaagccagtcacctaattagctgctactactcctgcagggggtggatggttcatcatcctgagctgttcagtagtaactctgccttggcactatgactataaactatgctgaggtgctacattcttagtaaatgtgccaagacctagtcctgctactgacactttcctcgccttgccatactctaaaggttctcaacggatctttccacctctgggcttatcagagttctcaggatctcaaataactaaaaggtaatcaaagcaataatacaatctgcttttttaagaaagatcttcactccatggacttcactgccatccccccaaggagcccatattcttccaggttatatacacaaaattccaaatacatagaagaagctagaaatgtctggaaatgtacgtgaaaacagtattatttaatggaaagctatacaaaatagaagtcttagatgtacatatttcttacattgttttcagtgtttatggaataacttacgtgattaagtactacacatgaatgaccaataggagaaaatttttgaaatctagatatatgttctgcatgatatgtaagacaaaatatgctggatgtttttcaaaatagaaataatgtgctctcccagaaatattaaga

SEQ ID NO: 18 - protein, 102 aa, equine
MNTSGFLIFCLILLTLSQGIPLSRNTRCTCIEISNGSVNPRSLEKLELIPASQSCPRVEIIATMKKNGEKRCLNPESKTVKNLLKAISKQRSKRSPRTLREV

SEQ ID NO: 19 - DNA, 1034 bp, equine
  CDS (25)..(798)
ctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcttgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaagcgcattttggaggacaaggaggaaaacccgctccccgccgccctggtccagccccacactgggaaactctgctggttcctggacgaggcagcggcccgactcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaaaaaaaaaaaaaaaaaaaaaaaaaaaa

SEQ ID NO: 20 - protein, 258 aa, equine
MAAPAPGLISVFSSSQELGAALAQLVAQRAACCLAGARARFALGLSGGSLVSMLARELPAAVAPAGPASLARWTLGFCDERLVPFDHAESTYGLYRTHLLSRLPIPESQVITINPELPVEEAAEDYAKKLRQAFQGDSIPVFDLLILGVGPDGHTCSLFPDHPLLQEREKIVAPISDSPKPPPQRVTLTLPVLNAARTVIFVATGEGKAAVLKRILEDKEENPLPAALVQPHTGKLCWFLDEAAARLLTVPFEKHSTL

SEQ ID NO: 21 - DNA, 1042 bp, equine
  CDS (91)..(933)
tttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcagatcaaatactccaaaagtggcattgcctgtttcttaaaggaagatgacagcgattgggacccaaatgacgaagagagtatgaacagcccctgctggcaagtcaagtggcagctgcgtcagtttgttagaaagatgattttgagaacctatgaggaatccattcctacaacttcagaaaagcgacaaaatattcctcccttagtaagagaaagaggtcttcagagagtagcagctcacataactgggaccagtcggagaagaagcacagtctcaattccacgctccaagaatgaaaaagcactgggccagaaaataaacgcctgggagacatcaagaaaaggacattcgttcttgaataatttacacttgaggaatggagagctggttatccatcaaacagggttttattacatctattcccaaacatactttcgatttcaggaggaaataaaagaaaacacaaagaacgacaaacaaatggtacaatatatttacaaaagcacagactatcctgaccctatactgctgatgaaaagtgctagaaatagttgttggtctaaagattcagaatatggactctattccatctatcaaggtggaatatttgagcttaaggaaaatgacagaatttttgtctctgtaactaatgagcaattgattgacatggaccaagaagccagtttcttcggggcctttttagttggctaactgacctggaaagaaaaagcaataacctcaaagtgactattcagttttcaggatgatacactatgaagatgtttcaaaaaatctgaccaaaacaaacaaacagaaa

SEQ ID NO: 22 - protein, 281 aa, equine
MAMMEVQGGPSLGQTCVLIVIFTVLLQSLCVAVTYVYFTNELKQMQIKYSKSGIACFLKEDDSDWDPNDEESMNSPCWQVKWQLRQFVRKMILRTYEESIPTTSEKRQNIPPLVRERGLQRVAAHITGTSRRRSTVSIPRSKNEKALGQKINAWETSRKGHSFLNNLHLRNGELVIHQTGFYYIYSQTYFRFQEEIKENTKNDKQMVQYIYKSTDYPDPILLMKSARNSCWSKDSEYGLYSIYQGGIFELKENDRIFVSVTNEQLIDMDQEASFFGAFLVG

SEQ ID NO: 23 - DNA, 838 bp, equine
gcacgaggaccatccatatcaaatatgcccattcaaacattacccagcatcatggcttatgatcaggaactccggtccttatgtctagtagcattttgaatcctttatgccatgatagtgccgcagtatcgagaggattttatggagaattggaatagtctccatgaccacagctaaataaaggacaagcagcctgtcttggggttttgaaaaggttattcttaacaatcttttttttttcctacccagggactttctgacagtatgactgttaccttacttgaaaagcagtacccaattgctttattattttaaatagattcacattaaccaacataattttttagattgtttaggattagcctgagtttctaagtcagcttccagctgtgtttcatctccttcacctgcattttatttggtgtttgtctgaaggaaagaggaaagcaaatgtgaattgtactatttgtactaatctttggaatttattggtaaatttatttcaggatagggtatcagaaaaagaaaaactttgtttcttagactgaaggtctaactgattaataatttgacttataagcatggtttgttcactccttcaaatgaatttactttgaaaacaaatgaagagctgctctccttctttcctccactaagcagatgatcctgctggattcccgctggagcagtgctaccctctgttccggtgattggtttgttcctttcttgtatcccccaaagtggacacaaacaactacacgatcccagagacatatctagttaattccagctgacgagagaccagaaaattgtaaatggatggtttgatattactgca

SEQ ID NO: 24 - DNA, 748 bp, equine
gacaatagcagttattaaattgggtctctcatctgtatgtttttgttacactgaggttaagaggccggattcttggcagccaggtccctcttcaggatcacgttggctgcaacgtgagttatattggagcactttaatctgaaggatgatactgtaacttgatttatctaattagcttttaattatctatagcgattttatttaatcctctcctacagtcctggggacctctgtaaacttctcagatgactcgtatttttgtagtgctacgaaatttatttacagacctataaagaaagctgtttattcacttgaagtctgaaaatgtacacagatatgtttattctgcaatctgttttgtacttgatagaaatatattttgactgtgataacccaagtgccctggggcaggggtactcggcatggttcctcctctgaagagcgggtgtggaaacctcaactgctcacgagaagtgcttggtttggggacagctgctgctaggacgtgggggatgtgacttggtcagggtgtgagaggggcgtctggctggaggagagttcctgtgctctgaaatgccacttgggaactctggagattgaaggacaatttacttcaagggtgtctggtttctaccactgctggaaaaaaattcggtttgtagcattcctgcacctcacaagtagatcgcctggaggtcattagttaatagctgtctgtgaggactctgctttcagggagaatttatct

SEQ ID NO: 25 - DNA, 682 bp, equine
aaaatgtcagtcctttgcctggttgttccatctcatctcattccttggactttgacagatatcctgccctgtgttttattcctgtgtgttaacctcatcagggaagcagaatggaggagcaagaaagtctgccctttgccatgccaaacagctctcagccctgtgtggtgaggcgtgtgcgcacgtacatgcatgagtggggtgcatgggtgtggtttccagctttgctgacagtgggagctcagcagagcgtagaggcaggaaggtccatggcactcagccacacactattgaaggctagaggcggtttagtgttagattatgcgggatcttccctccctgggtcacttctcccaatcaacctttttttcttttttagaactactaattaatgattcctcaaggccgaaaggttaatttccttgggaggagaacttagcctcctagtatccacaccagtctcaactctggtttctcaagatctgtcacgttggcctactaacttgacgtcttcccccctcccactgaaggatcgcccagcgtttttagattgtagaattatctcttgctttgttactttgggaattttgaatttctttggttttgtttttaagaagtaacctaaaatttcctacaacactaaataaaatggtactacctttcaaaaaaaaaaaaaaaaaaa

SEQ ID NO: 26 - DNA, 604 bp, equine
  misc_feature (4)..(4): n is a, c, g, or t
aatntcagttacttcagaaagttttaatttagagtaattccaattcatgcatataagcatgaattgaaaagataactatgattgttcttatataaaaatatgattgccatagaagttaatgaatacacttataagaatgtaatatgatttccctttacttcctacccttctgttaaactgctgctactggagttcgcctttaaaaaatacttgttcttagctttacagaagttgagatttgaagtccttggcatcctgaagtatgttatatgccatgtgcttgttatgaagattatggtatgccaggagacattctcctgattttcattatatagagaatcatatttgagaatgctgttcttcttatcttttataacatcaatttccgttgtttcgcttgtctttttttaaatgtcgtcggtttaaagagtttacttcattaaacactttacttcagcagtttgaatagtagatggaaaaataggccccggtctacattaattttccccagtctgcattagaatatttttgaagattatacttttccaaacaaagaaaataatttgtattttgtgtctaaaattaaactttgtttaaaactctg

SEQ ID NO: 27 - DNA, 1212 bp, equine
  CDS (154)..(789)
tgcaaggtgggaagtgaagtcagtgcctcagttgctgatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaaaaaaaaaaaaaaaaaaaa

SEQ ID NO: 28 - protein, 212 aa, equine
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGKAINVFVSANRLIHQTNLILQTFKTVA

SEQ ID NO: 29 - DNA, 899 bp, equine
  CDS (204)..(482)
gggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccagtaccagctagtggacatctctcaggacaacgccctgcgggatgagatgcgagccttggcaggcaaccctaaggccaccccaccccagattgtcaacggggaccagtactgtggggactatgagctcttcgtggaggctgtggagcaaaacacgctgcaggagttcctgaaactggcttgagtcaagcctgtccagagttcccctgctggactccatcaccacattccccccagccttcacctggccatgaaggaccttttgaccaactccctgtcattcctaacctaaccttagagtccctcccccaatgcaggccacttctcctccctcctctctaaatgtagtcccctctcctccatctaaaggccacattccttacccactagtctcagaaattgtcttaagcaacagcccaagtgctggctgtcctcagccaggccctggggctgccaccctgcctgacactggctgatgggcacctatgttggttccattagccagggctctgccaaaggccccgcaatccctctcccaggaggaccctagaggcaattaaatgatgtcctgttccattggcaaaaaaaaaaaaaaaaa

SEQ ID NO: 30 - protein, 93 aa, equine
MSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 31 - DNA, 495 bp, equine
  CDS (16)..(405)
ccggacggcctcaccatgatgaaacgggcagctgctgctgcagtgggaggagccctgaccgtgggggctgtccccgtggtgctcggcgccatgggcttcactggggcaggaatcaccgcctcgtccttagcggccaagatgatgtccacggccgccattgccaacgggggtggagttgcggccggcagcctggtggccactctacagtccgtgggagcggctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgcaaaaaaaaaaaaaaaaaaaaaaaaaaaaaaaaaaaaaaaaaaaaaaaaaaaaaaaaaaaaaaaaaaaaaa

SEQ ID NO: 32 - protein, 130 aa, equine
MMKRAAAAAVGGALTVGAVPVVLGAMGFTGAGITASSLAAKMMSTAAIANGGGVAAGSLVATLQSVGAAGLSTSSNILLASVGSVLGACLGNSPSSSLPAEPEAKEDEARENVPQGEPPKPPLKSEKHEE

SEQ ID NO: 33 - DNA, 934 bp, equine
ggcttttgaagaggtttggagacaagttttgtttgtcgcgaggacttggggctcctactggcgtgtagcgggcagggactaggggttctaaacagcctgccatgcgtctgtgcaatgaagagttggcccaccccctggatcccccttgagagactctggcagctgatgtggctccttgtggaaacaagaggaacagggaataaggattcccacctctcctgtcaggaaagcgttgacactgacctactctgggaatggacggggaaagattctgggagctgggagtcactgctgaaactggcaaacaattactaggcattaagtctgcggagggccatttgctgtgcagaaccaaggaacacaaacaataagaagaccgtccgtacccgtcctgaaggagttcacggtcaggctgggagaaataatagcaataataataacgcattaagtttctgctgaataccggatgtgtttacatccatcttttcacttgatgcagtcctgaatctggttctatgatcagcccccaggtacagaggaggacactgaggctcagcggttacatgacatacgtcatgtaacccctcatgtatgtgatgtaacacagaagtatgggaccgagctgggatttgaacccaggtctcacaccaaggcccgtgatttttctaccagacctcactgcctctgtgcttagggaagagatcatatctgccccagctggatgtttcgaggatcctcctccctctagacattgggagaaagattctttggaaccccccccaaacacacacacacaccaagttgagtgacctaaagaaaaggggacaaggtggccaatgcaaattgagagctccctgtcctcagccctgaactgggaattgctgaatgggagcaataaaatggaaaaaggccaagtggctgcttggaaaggtgg

SEQ ID NO: 34 - DNA, 501 bp, equine
tctagacattgggagaaagattctttggaaccccccccacacacacacacacaccaagttgagtgacctaaagaaaaggggacaaggtggccaatgcagattgagagctccctgtcctcagccctgaactgggaattgctgaatgggagcaataagatggagagaggccaagtggctgcttggagaggtggtcacaggggtaggagacttagctctacacgctcaaactcccagggtcctgggcttcccaagggccacagtctctagccaaccaaactcacaagagcctgatgtataagccagaggcccagtgtttccaccaggcgtggagtaagcagataagagctcagctctggagctgttagtgcctggtgtaactcttgcctccaccaatcactagccctgtgattctgtgcaagttattgattgatctctctaagcctcaatttcctcatctgtgaaatggcaataaaatgttcaatacaaaaaaaaaaaaaaaaa

SEQ ID NO: 35 - DNA, 2373 bp, equine
  CDS (6)..(2126)
tcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaaaaaaaaaaaaaaaaaaaaaaaaaaaaaaaaaaaaaaaaaa

SEQ ID NO: 36 - protein, 707 aa, equine
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 37 - DNA, 500 bp, equine
gcacgaggcagccagcagctttggagcccccacaacctggacactcacatcgaagtctctgcctagccaccctctccctgagcccatctcagatgcccctcccccccaggctgccaggtggctggggtgaggtcaggtggcaggcccagaataggcccagtcatccactcccctccctctcaggattgcaggagtctgagctattcccggccacctctatctcccaccccaccttctccaccatagccaggggctgggccccgtaggtgaaacaagcgggtgaaacccctctggggcccagacatgcaaacctctggcaccactgggtcctggctgaacccctgggtggtgtgcagcttcccctctggtctcagtttcctttcctgaaaagcgaggagttggaggcaacgttctcctcctggcctgtggccctcagaggagaaggactggaaggaacttcagagaatcctcactcccctcattttacagatgaggaaact

SEQ ID NO: 38 - DNA, 562 bp, equine
cctttcctgaaaagcgaggagttggaggcaacgttctcctcctggcctgtggccctcagaggagaaggactggaaggaacttcagagaatcctcactcccctcattttacagatgaggaaactgaggcccagagtgggcagagacttggcatcattgtcatccagcaaataacagaagggaagttccttggggaagaaccaggagcagaggtctggggagaggtgggcaaggagggggtcagtctcccctagtccagaaaagggcctcacctgccaggggcctccagtctctggccctctgtcctgcgcattgctttccaaggagccttcttgaggtcactgcatttgatcttcatggcggcacctggaagagagacatgagcgtttgtgtttgctttaaaaaaagcatttttcattttaaaaaatcaaggtgtgctttgtagacactttggaaagttcaggagagtaatccagggtggagtctatgcagaaatgacccataatccagcaacgccaggcccctgagtggtggcttctatgtagctgtaatcgtactatacat

SEQ ID NO: 39 - DNA, 1956 bp, equine
  CDS (33)..(1364)
attgttatcaactctttgatatctgatgatcaatgctccaaagaattggattaatatttttacacaatattgttgtagtcagtaactgtttctatttccaggcatttttagatgaattcactaactggtcaagaataaatcccaacaaggccaggattcccatggcaggagatacccaaggtgtggtcgggactgtctctaagccttgtttcacagcatatgaaatgaaaatcggtgcaattacttttcaggttgctactggagatatagccactgaacaggtagatgttattgtaaactcaacagcaaggacatttaatcggaaatcaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggaaatgccggaaaaaaccctatcacagttgctgataacataatcgatgctattgtagacttctcatcacaacattccaccccatcattaaaaacagttaaagttgtcatttttcaacctgagctgctaaatatattctacgacagcatgaaaaaaagagacctctctgcatcactgaactttcagtccacattctccatgactacatgtaatcttcctgaacactggactgacatgaatcatcagctgttttgcatggtccagctagagccaggacaatcagaatataataccataaaggacaagttcacccgaacttgttcttcccacgaaatagagaagattgagaggatacagaatgtatttctctgggagagctaccaggtaaagaaaaaccacatggacaccaagaatggccataccaataacgagagacaactcttccacggcacagatgcagacacagtgccgtacatcaatcagcacggctttaatcgcagttatgctgggaagaacgctacagtctttggaaaaggaacgtatttcgctgttgatgccagttattctgctaacgatgcatactccagagcagacagcagtgggagaaagcatatttacgttgtgcgagtacttacaggagtctacacagttggacacgcagcaataaaaagccctccaccaaagaaccctgacaaccctacggatctgtttgactctgtcacagatgatacacggcatccaaagctatttgtggtattctctgatcatcaagcttacccagaatatctcataactttcacggcttaaaaatatttttatcatcaaagagatgatttaagtcatctgtaagaacaacatgcaatctttgtctttgcttctggcctgtgtaagcagatgaaagtttcccttttaggtgccaaaatgctgaaaattacctttttaaagtgctctattgctgcgatttgtagcatacctttttttctcagcaaattgatgggtggaagctgagaaatgtatggtaaatgtcacagagctacaaccattcacagacaccaaatctctaggagaataaaaagcacattattctttttctatcagaaaaaaacaagatgcatcaccttaaaaccaagatgacattgttcttcttggaacatgttaagacatcgaatggtggcgggttaaactgtactgcttaagtggagcggctaccgttatgcatctatcacagttggggattttgccttattaaggaaaacttgtcaatagttcagctgaaatgactgaatcacagaatattaactctgttatggaacaaatcataacagattttacctgtttacatttcaggtaaaaatgtatcgcattgttatctaatattaaaaaattacccccaatt

SEQ ID NO: 40 - protein, 444 aa, equine
MLQRIGLIFLHNIVVVSNCFYFQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSHEIEKIERIQNVFLWESYQVKKNHMDTKNGHTNNERQLFHGTDADTVPYINQHGFNRSYAGKNATVFGKGTYFAVDASYSANDAYSRADSSGRKHIYVVRVLTGVYTVGHAAIKSPPPKNPDNPTDLFDSVTDDTRHPKLFVVFSDHQAYPEYLITFTA

SEQ ID NO: 41 - DNA, 905 bp, equine
  CDS (46)..(747)
gtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaacccccacccaagtcaactgccggtgtctcccgccctggacttgaagtcaaccccacacatgtgacagacgtcaccaggatctctgtgttcagcattgtcattcctgtggcgtgcgcactcgtgactaagagcctggtccttactgtcctgtttgctgtcacacagaagtcatttggatcctaggcccatggacccatgaggatgacctctgatctccatctacatccatctggcagttgtgccaagggaggagggaggaggtaaaaggcagggagttaataacatgaattaaatctgtaatcaccgccaaaaaaaaaaaaaaaaaaaaaaaaaaaaaa

SEQ ID NO: 42 - protein, 234 aa, equine
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQPPPKSTAGVSRPGLEVNPTHVTDVTRISVFSIVIPVACALVTKSLVLTVLFAVTQKSFGS

SEQ ID NO: 43 - DNA, 1823 bp, equine
  CDS (65)..(1369)
ccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagctcagacttacctggacaaggtggagaacacttgcaagaagtttgcaaatccctccagctatagaatcgactgtcctcagatggactgtgaggaaggatgggccttgctgaaatgtggaggaaagaattataaacgggccaaggcctgctttgaaaaggctctggaagtggacccagaaaaccctgaattcagcactgggtatgcaatcaccgcctatcgcctggacggctttaaattagccacaaaaaatcacaagccattttctttgcttcccctaaggcaggctgtccgcttaaatccagacaatggatatattaaggttctccttgccctgaagcttcaggatgtaggacaagaagctgaaggagaaaagtacattgaagaagcgctgaccaacacgtcctcgcagacctatgtccttcgatatgcggccaagttttacagaaaaaaaggctctctggataaagctcttcagctctttaaaaaggccttgaaagcaacaccctcctctgccttcgtgcatcaccagatagggctttgctacagaggacaagtgattcaaatgaagaaagctgcaaactggcagcctagaggacaggatagaaaaaatgttgagagaattgcaagattagccatatctcatttggaatttgctctggaagaaaaacccacacttgatattgcttatgtagacctggcagaaatgtatatagaagcaggtgaccacagaaaagctgaagacacttatcaaaaagtgttaaccatgaaagtactcgaagaagaaaagctgcaaagggtacatttctcctatggccgatttcaggaatttcaaaataaatctgaagaccatgcaattatccattatttaaaagcagcagaaatagaaaacgcatcttttctaagagataaaagtatcaggtctttggagaaattggctttaaagaaacttcagagaaaccagtggtagaagaaacaatgcaagacatacatttctactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacattttatgttaacacatactaatcatcttacctgcttgctgctttcagaacatgttatgtaatttactgtaatgatgcaatttttgaataataaatctgacaaaatatt

SEQ ID NO: 44 - protein, 435 aa, equine
MSTNGDDHQVKDSLEQLRCHFTWELSIDDDEMPDLENRVLDQIEFLDTKYSVGIHNLLAYVKHLKGQNEEALKSLKEAENLMQEEHDNQANVRSLVTWGNFAWMYYHMGRLAEAQTYLDKVENTCKKFANPSSYRIDCPQMDCEEGWALLKCGGKNYKRAKACFEKALEVDPENPEFSTGYAITAYRLDGFKLATKNHKPFSLLPLRQAVRLNPDNGYIKVLLALKLQDVGQEAEGEKYIEEALTNTSSQTYVLRYAAKFYRKKGSLDKALQLFKKALKATPSSAFVHHQIGLCYRGQVIQMKKAANWQPRGQDRKNVERIARLAISHLEFALEEKPTLDIAYVDLAEMYIEAGDHRKAEDTYQKVLTMKVLEEEKLQRVHFSYGRFQEFQNKSEDHAIIHYLKAAEIENASFLRDKSIRSLEKLALKKLQRNQW

SEQ ID NO: 45 - DNA, 2431 bp, equine
  CDS (525)..(2282)
ctccaggctgtggaacctttgttctttcactctttgcaataaatcttgctgctgctcactctttgggtccacactgcctttatgagctgtaacactcactgggaatgtctgcagcttcactcctgaagccagcgagaccacgaacccaccaggaggaacaaacaactccagacgcgcagccttaagagctgtaacactcaccgcgaaggtctgcagcttcactcctgagccagccagaccacgaacccaccagaaggaagaaactccaaacacatccgaacatcagaaggagcaaactcctgacacgccacctttaagaaccgtgacactcaacgctagggtccgcggcttcattcttgaagtcagtgagaccaagaacccaccaattccggacacgctaattgttgtagatcatcacttcaaggtgcccatatctttctagtggaaaaattattctggcctccgctgcatacaaatcaggcaaccagaattctacatatataaggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctacctagccctggaagcagatgggcaactcgtcacagccgatgaatacctggagaattcgctgaggcaaaagcaaggcaccgatcgaagtctccaaaatttcaatttgccccgtctgtgtatacagaaattctttccaagaaagaaatgctttatttttgacttgcccactcaccggaagaagcttgcccacctcgagacactgcataatgatgagctggattctgactttgtgcaacaagtggcagaattctgttcatacgtcttcaagcattccaagactaaaaccctttcaggaggcattaaagtcaatggacctcaattagagagcctggtgctgacctatgtcaacgccatcagccgtgggtatctgccctgcatggagaactcagtcttggccttggctcagatcaagaactcagcagcagtgcaaaaggccattgctcactatgaccagcagatgggccggaagctgcagctgcccacggaaaccctccaggagctgctagacctgcacagggccagtgagaaagaagccattgccgtcttcatgaagaactctttcaaggatgtgaaccaaagtttccagaaaaaattacggacccagctagaagcaaaacaggatgacttttatcaacagaacttggaggcatcactggatcgttgctcagctttacttcaggatctttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacggaaaaaaagaagaaagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaactttaaaaaaaaaaaaaaaaaaaaaaaa

SEQ ID NO: 46 - protein, 586 aa, equine
MALEIHMSDPMCLIENFNEQLKVNQEALEILSAITQPVVVVAIVGLYRTGKSYLMNKLAGKNKGFSVASTVQSHTKGIWIWCVPHPNWPNHTLVLLDTEGLGDVEKADNKNDIQIFALALLLSSTFVYNTVNKIDQGAIDLLHNVTELTDLLKARNSPDLDRVEDPADSASFFPDLVWTLRDFYLALEADGQLVTADEYLENSLRQKQGTDRSLQNFNLPRLCIQKFFPRKKCFIFDLPTHRKKLAHLETLHNDELDSDFVQQVAEFCSYVFKHSKTKTLSGGIKVNGPQLESLVLTYVNAISRGYLPCMENSVLALAQIKNSAAVQKAIAHYDQQMGRKLQLPTETLQELLDLHRASEKEAIAVFMKNSFKDVNQSFQKKLRTQLEAKQDDFYQQNLEASLDRCSALLQDLFGPLEEAVKQGIYSKPGGHNLFIQKTEELKAKYYREPRKGIQAEEVLQKYLKSKESVSHAILQTDQALTETEKKKKEAQVKAEAEKAEAQRLAAIQRQNEQMMQERERLHQEQVRQMEIAKQNWLAEQQKMQEQQMQEQAAQLSTTFQAQNRSLLSELQHAQRTVNNDDPCVLL

SEQ ID NO: 47 - DNA, 2228 bp, equine
  CDS (190)..(1086)
agagacttcagcgcctgggactcgggtgggcgaggcggaaggtgtcctcgcagcacggcttttctccgcgccgcggttggttagcgagtgccctctgggtgctaggcgttgggcggatggtaggatcgcggtagcatacggatccgagtcctgcgccgagtgagaggagaggctggcaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaaaaaaaaaaaaaaaaaaaa

SEQ ID NO: 48 - protein, 299 aa, equine
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFKNPSSFEGKGPLSYVKEMTEGKRSSHSGNGCKNEKLFNGEFTKTE

SEQ ID NO: 49 - DNA, 1226 bp, equine
  CDS (51)..(974)
ggcgcgctgggccttggggagctgcgctcggcgggcggacgcgggggatcatggaagctgataaagatgacacacaacaaattcttaaggagcattcgccagatgaatttataaaagatgaacaaaataagggactaattgatgaaattacaaagaaaaatattcaactaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcatttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacattgcgtgaagatcaaatgagagacaagctagaactgagcttttgtaagtcccgacacggaggaggagaggtggaatgcgtgaagtacgataagcggtctggaagtgctgtcatcacgtttgtggaaactggagttgctgacgagattttgaagaagaaagactatcctctttatacagatcatagctgccatagagttactgtttctccgtacatagaaaaacacttgaaaaagtttcaggtattttcaggaatatctaagaggacagtgcttctgactggaatggaaggccttgatatgatggatgaagaaactgtggaggatttagttagcattcactttcaacgggagaagaatggaggtggtgaagtcgatgtggtcaaatgttctctaggtcaaccttacatagcatactttgaagaatagacttaacagaatcatgaaaactatagctttttaacccggattactgtaaatgtttgacaaaaatgagtatccttttccttaaaaaaatgaaaactttaattctttactatcatttatttttagatacaaaatatgtttccacgtttttgaattcttctttctttcaaactgtgctgcatgttcacaaatgcaataagtgcactgaattaaaaagttttgtttatagaaaaaaaaaaaaaaaaaaaaaaa

SEQ ID NO: 50 - protein, 308 aa, equine
MEADKDDTQQILKEHSPDEFIKDEQNKGLIDEITKKNIQLKKEIQKLETELQEATKEFQIKEDIPETKMKFLSVETPENDSQLSNISCSFQVSSKVPYEIQKGQALITFEKEEVAQNVVSMSKHHVQIKDVNLEVTAKPVPLNSGVRFQVYVEVSKMKINVTEIPDTLREDQMRDKLELSFCKSRHGGGEVECVKYDKRSGSAVITFVETGVADEILKKKDYPLYTDHSCHRVTVSPYIEKHLKKFQVFSGISKRTVLLTGMEGLDMMDEETVEDLVSIHFQREKNGGGEVDVVKCSLGQPYIAYFEE

SEQ ID NO: 51 - DNA, 2854 bp, equine
  CDS (259)..(2157)
agaactcacatcggatgattcaggcatggctctgctaacactttattaaaagcatggattaattttacttccaagtttatttttactgcaccgtcccatttgtggaaacaactagcttactcagcttttttttccttttataaaggaaagaacagaaaagtaaaaggaggaaagaaaacaagaggtgagtgaggcaactgaaaactgttcttggacctgcggtgctatagagcaggctcttctaggttggcagttgccatggaatctggacccaaaatgttggcccccgtttgcctggtggaaaataacaatgagcagctattggtgaaccagcaagctatacagattcttgaaaagatttctcagccagtggtggtggtggccattgtaggactgtaccgtacagggaaatcctacttgatgaaccatctggcaggacagaatcatggcttccctctgggctccacggtgcagtctgaaaccaagggcatctggatgtggtgcgtgccccacccatccaagccaaaccacaccctggtccttctggacaccgaaggtctgggcgatgtggaaaagggtgaccctaagaatgactcctggatctttgccctggctgtgctcctgtgcagcacctttgtctacaacagcatgagcaccatcaaccaccaggccctggagcagctgcattatgtgacagagctcacagagctcatcagggcaaagtcttccccaagacctgatgaagtacaagattccacagagtttgtgagtttctttccagactttatctggactgtacgggatttcaccctggagctgaagttagacggtcaccctatcacagaagatgagtacttggagaatgccttgaagctgattccaggcaagaatcccaaagtccaagcgtccaatctacccagagagtgcatcaggctattctttccaaaacggaaatgttttgtatttgaccggccaataaacgacaaagcactcctagctgacattgagaatgtgtctgaaaacgaactggattctaaattccaagaacaaataaacaagttctgttctcacatcttcacccatgcaagacctaagactcttagagagggaatcatggtcactgggaatcggctgaggactctggtggtgacctatgtggataccatcaatactggagcagtgccttgtttggagaatgcagtgagaactctggcccaacttgagaactcagtggccatgcagaaggcagcggaccattacagtgagcagatggccgagaaattgaagttgcccacagacacactccaggagctgctggacgtgcacacagcctgtgagagagaggccattgcatttttcatggagcactccttcaaggatgaaaatcaggaattccagaagaagttcatggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgaacaggactattggcaagttcccaggaaaggagtaaaggcaaaagaggtcttccagaggttcctggagtcacagatggtgatagaggaatccatcttgcagtcagataaagccctcactgatagagagaaggcagtagcagtggatcgggccaagaaggaggcagctgagaaggaacaggaacttttaaaacagaaattacaggagcagcagcaacagatggaggctcaagataagagtcgcaaggaaaacatagcccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctttggactatttttgatctgtatgtttttcattttcattcagcaagtttttttttttttcagagtcttactctgttgcccaggctggagtacagtggtgcaatctcagctcactgcaacctctgcctcctgggttcaagagattcacctgcctcagccccctagtagctgggattataggtgtacaccaccacacccagctaatttttgtatttttagtagagatggggtttcactatgttggccaggctggtctcgaactcttgacctcaaatgatccacccgcctcggcctcccaaagtgctgggtttacaggcatgagccaccatgcccagccctcatttagcaaagttttaaacatgaaaagtgcttattagaggatatcagtgcctggcccacatgagagaacagatccatacacactttgaaaaactttgttcacttttaggaaatataattttgaaaaatcatttacatacaagaggtccactgaggcattgcttttaatggcaaaatattgcaatgtacttgaatgtccttcacattagattggtaagataaattttagtatgtgcatgtactggaatattatatagccagtaaacaaattgacaatgaagctctatttgtaccagtaaagaatggtcttgaagagacattgtaaaatga

SEQ ID NO: 52 - protein, 633 aa, equine
MESGPKMLAPVCLVENNNEQLLVNQQAIQILEKISQPVVVVAIVGLYRTGKSYLMNHLAGQNHGFPLGSTVQSETKGIWMWCVPHPSKPNHTLVLLDTEGLGDVEKGDPKNDSWIFALAVLLCSTFVYNSMSTINHQALEQLHYVTELTELIRAKSSPRPDEVQDSTEFVSFFPDFIWTVRDFTLELKLDGHPITEDEYLENALKLIPGKNPKVQASNLPRECIRLFFPKRKCFVFDRPINDKALLADIENVSENELDSKFQEQINKFCSHIFTHARPKTLREGIMVTGNRLRTLVVTYVDTINTGAVPCLENAVRTLAQLENSVAMQKAADHYSEQMAEKLKLPTDTLQELLDVHTACEREAIAFFMEHSFKDENQEFQKKFMETTMNKKGDFLLQNEESSVQYCQAKLNELSKGLMESISAGSFSVPGGHKLYMETKERIEQDYWQVPRKGVKAKEVFQRFLESQMVIEESILQSDKALTDREKAVAVDRAKKEAAEKEQELLKQKLQEQQQQMEAQDKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 53 - DNA, 567 bp, equine
  CDS (1)..(564)
atgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatgagccgctccccagacccttcctggacatgggggagggcaccaagaacaacatcatcacagccgaggggatcatcctgctgttctgcgcagtggtgcctgggacgctgctgctgttcaggaaacgatggcagaacttgaagttcgggccagacatccaggatgactacgaagatgagaatctttatgagggcctgaacctcgatgactgttccatgtacgaggacatctcccggggcctccagggcacctaccaggacgtgggcagcctccacatcggagacgtccagctggagaagccgtga

SEQ ID NO: 54 - protein, 188 aa, equine
MPGGPGVLQALPATIFLLFLLSAVYLGPGCQALWMHKVPASLMVSLGEDAHFQCPHNSSNNANVTWWRVLHGNYTWPPEFLGPGEDPNEPLPRPFLDMGEGTKNNIITAEGIILLFCAVVPGTLLLFRKRWQNLKFGPDIQDDYEDENLYEGLNLDDCSMYEDISRGLQGTYQDVGSLHIGDVQLEKP

SEQ ID NO: 55 - DNA, 2608 bp, equine
  CDS (105)..(2084)
ggcacgagtggagaacagctctgcatttctgtccaagcagtcagcggtccatcgtcaagtaaaggaagctatattggagataactgaaccgataaaggaagaagatggttcattctgaagcgaaaatgacaagacctgattcagcttccgcatccaagcaacaattactaaatggaaatgctgacatacaggagacaaatcagaaaagaagcattgagaaaaacctgtgtagccagtatgaggagaaggtacgcccatgcattgatctcatcgactccctgcgggctctgggtgtggagcaggacctggccctgcctgccatcgccgtcatcggggaccagagctcgggcaagagctctgtgctggaagctctttcaggggtcgcccttcccagaggcagtggtattgtgacaagatgtcctctggtgctgaaactgaaaagactggtgaaagaagatgagtggaaaggcaaagtcagctaccgggatatcgaggttgagatttcaaatgctttggatgtggaagagcaagtcagaaaagcccagaatgtccttgctggggaaggagtgggaatcagtcaggagctagtcactctggaagtcagctctcctcatgtcccggatctgaccctgatcgaccttcctggcatcaccagggtggccgtgggcaatcagccagccgacatcggacgtcagatcaagacactcatcaggaagtacatccagaggcaagagacgatcaacctggtggtggtccccagtaacgtggacatcgccaccacggaggcgctgagcatggctcaggaggtggaccccgagggagacaggaccataggaatcttgacaaagcctgacctggtggacaaaggcaccgaggagcaggtggtagacgtggtgcgaaacctcatctgccacctgaagaagggttatatgatcgtcaagtgccggggccagcaggacatccaggaccgactgagcctggctgaggctctgcagagagagaaggccttctttgaggaaaacccatatttcaggggccttctggaggaaggaagagcctcggtcccctgcctggcggagaggctgaccactgaactcatcacgcacatcagtaaatctctgcccctgttagaaaatcaaataaaggaaagttaccagaatctatcagacgagttacaaaaatatggcaccgacatcccagaagatgaaactgaaaaaacgttcttcctgatagtgaaaattactacatttaatcagaacatcacctctttcgtacaaggggaggaacttgtaggacccaatgacactcggctgtttaacaaaatccgacaggagttccagaaatggagtggggtgattgaaaacaatttccgaaaaggtggcgaagctatccgtagacagatctggacatttgaaaatcagtatcgtggcagagagctaccaggatttgtgaattacaggacatttgagacgatcatcaaacagcaaatccagttgctggaagagccagccattgatatgctgcacaggataagtgatctggtccgggataccttcacaaaagtttcagaaaaaaatttcagtgaatttttcaacctccacagaaccaccaagtccaaacttgaagacattaaattagaacaagaaaatgaagctgagaagtcgatccgactccacttccaaatggagaagatcgtctactgccaagaccacgtttaccggggcacgttacagaaggtcagagagaatgaaatggaggaggagaagaagaaaaaaacaatcaacgtctggggtcaaaacacttccacagagtcctcgatggcagaaatcttggagcatctcaacgcctaccagcacgaggccggcaaccgcctctcgacccacatccccttgatcatccagttcttcgtcctccagacattcggccagcagctgcagaagtccatgctgcagctcctgcaggacagggacacctacgactggctcctgaaggagcgcaacgacacctgtgacaagaggaagttcctgaaggagcggcttgctcggctggcccaggctcggcgccggttagccaagttcccgggttaaatcgggctctctgtctcagcctcatgtctccatgcacatctccagggagcggaggcccagcatctctccccaacagccacaccatcattagttacccattcacagatacccgagcggttacgggtcaggcttggtggtcactgtctgtgcttgtcctttagtggataaggatgcgctaagaacctgtgatgagcgatttggtttcaagcattgagactagagccccgccttcatgtagcatatgctttagactgaatgagcagtgccattttctggttaggagaaatggttttctacccccaggattggtcctcgtctccagactctctccatctctttatcagagaccgatgtacgtgcagcatcatggaacggttattttcggtttttttgtgttgtcctttcgcatacccagtgttttaggcgtgtgagtgctgcttgtgtgaatgcttgtagatgccatgtttcatctatttgtaataaacttttttctactagaaaaaaaaaaaaaaaaaaaaaaa

SEQ ID NO: 56 - protein, 660 aa, equine
MVHSEAKMTRPDSASASKQQLLNGNADIQETNQKRSIEKNLCSQYEEKVRPCIDLIDSLRALGVEQDLALPAIAVIGDQSSGKSSVLEALSGVALPRGSGIVTRCPLVLKLKRLVKEDEWKGKVSYRDIEVEISNALDVEEQVRKAQNVLAGEGVGISQELVTLEVSSPHVPDLTLIDLPGITRVAVGNQPADIGRQIKTLIRKYIQRQETINLVVVPSNVDIATTEALSMAQEVDPEGDRTIGILTKPDLVDKGTEEQVVDVVRNLICHLKKGYMIVKCRGQQDIQDRLSLAEALQREKAFFEENPYFRGLLEEGRASVPCLAERLTTELITHISKSLPLLENQIKESYQNLSDELQKYGTDIPEDETEKTFFLIVKITTFNQNITSFVQGEELVGPNDTRLFNKIRQEFQKWSGVIENNFRKGGEAIRRQIWTFENQYRGRELPGFVNYRTFETIIKQQIQLLEEPAIDMLHRISDLVRDTFTKVSEKNFSEFFNLHRTTKSKLEDIKLEQENEAEKSIRLHFQMEKIVYCQDHVYRGTLQKVRENEMEEEKKKKTINVWGQNTSTESSMAEILEHLNAYQHEAGNRLSTHIPLIIQFFVLQTFGQQLQKSMLQLLQDRDTYDWLLKERNDTCDKRKFLKERLARLAQARRRLAKFPG

SEQ ID NO: 57 - DNA, 3105 bp, equine
  CDS (159)..(1604)
agcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcagctcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtctcgaatacacagttgtatttaatgttttctgatcccccagccgtcccagcccacgcactttttcacaaacgtttgtcctcgttgagggtttcgttctcgggtttttgtgtttgtttttgtgggtattgcctcattccatccctgagctttgcaggtagacagatgtgattcagaactatgttccagggtgttccttgtaggagtaattggtttgcagtaagaagtcacacttttccactaaaggggaggaggtggtaatctacgagacaagctaaagttaagttgttagaagaattccttgattggaattttagctttgcattttgttgctctctttcctggaaataattcggagacgctcctgatttgtccatctactgctttggttccttggatccacccattctttcactttaagaaaaacaagtaattgttgcagaggtctctgtattttgcagctgcccttttgtaagaagcacttttcccaaataaaacaatgaaaaaaaaaaaaaaaaaaaaaaaaaaaaaaaaaaaaaaaaaaaaa

SEQ ID NO: 58 - protein, 482 aa, equine
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQLLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 59 - DNA, 3016 bp, equine
  CDS (104)..(2560)
gagcggcctgccggaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgtgaagtggtttgcagagttggctttcaaagaatgtactcggtgccccacgacccaaagtatggacctggcatatacttcaccaagaatctcaaaaatctagcatcccagttcaagaaaacgtctgccacagataagctgatctatgtgtttgaggctgaagtactcacaggctccttctgtgagggtcatcagttaaatattgttcccccacgattgagtactgatgccatagatagccatgacagtgtggttgacaatgtctccagccctgaaacctttgttatttttagtggcacgcaggctatgccccaatatttgtggacttgcacccaggatcatgtagggccagaggattactcattaggacaaatgttgccgtctccacagcagcttgggaagagattcgtaagtggcagccctgttgactaacttctgcataattttaacaactggcatggccctgctttggagaaactaacgaaatattgaccatcaatgactcaaagactggtctgaatatgtcaaatggctctggatagactgaatgggttactgaaggggccagccacatactagcatcttggtgccttcgtctttgttttcatctcttgggggtggggtgggtagatactaactaaaacactctcaggaccttccttcctcttgcagttgttctttaatctcctttactagaggagataaatattttgcatataatgaagaaatttttctagtatataattcaagccctctattttttaaaatggtgatagtataaaaatgttaggataacagaatgattttagattttccagagaatattataaagtgctttaggtatgaaaataaatcatctttgtctgattaaaaaaaaaaaaaaaa

SEQ ID NO: 60 - protein, 819 aa, equine
MDFSMVAGAAAYNEKSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCEVVCRVGFQRMYSVPHDPKYGPGIYFTKNLKNLASQFKKTSATDKLIYVFEAEVLTGSFCEGHQLNIVPPRLSTDAIDSHDSVVDNVSSPETFVIFSGTQAMPQYLWTCTQDHVGPEDYSLGQMLPSPQQLGKRFVSGSPVD

SEQ ID NO: 61 - DNA, 1985 bp, equine
  CDS (157)..(1767)
  misc_feature (1822)..(1822): n is a, c, g, or t
accaggcaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctntgggccacaacccaacccttctcactctcctcagtgctagcactttgtattttttgatacttttatacttgtttctgcttttgctgctcttgatcccacctttgctcctgacaaccctcattcaataaagaccagtgaagaccaaaaaaaaaaaaaaaaaaaa

SEQ ID NO: 62 - protein, 537 aa, equine
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPAQAPQA

SEQ ID NO: 63 - DNA, 1649 bp, equine
  CDS (104)..(334)
gaaggccggaagcttaccagccgagaaggaattcctagctagcttcagagccggtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcccaaggacatggccacctgggtccactccagtgacagacccctgacaaagagcaagtccctggaggctgagttgcatggggtcttgtcaccccaagccagtgagcctctaatgccaccgcgccctaggggctcccagagcctgggcaacttagctgtgactggcaaaggagaaaggtagtttgagatgtgacgccagttagttccagaaagtatcaggggtctgtttttcatttccatggacatcttcagcagcttcacctgacaatgactgttcctatgaagaagccacttgtgttttaagcagaggcaacctctctcttttcccccgcctcgccaaggcagggccacagatgggagagattgagccaagtcagccttctgttggttaatatggtctaatgcatggctttgtgcacagcccagtgtgggattacggctttgggatgaccgcttacaaagttctgtttggttagtattggcatagtttttctatatagccatacatgcgtatatatacccatagggctagatctatatcttagtgtagcgatgtatacatatacacatacacctacgtgtcgaagggcctaaccagctttgggaatattgactggttccttatctcttaaggctaattctttgactgtgttcatttaccaagttgatccagtttgtcctttaggttaaataagactaaagcgtaaagacagggagggggccagcctctgaatgtggccacagatgccttgctgctgcaacccttgccccatctgtcccctgaagacttgtgaggtcctcttttgaaagccaaacccaccattcactggtgctgactacaaagaatgggtttgagagaagatcagctaggacttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttctgacacctgatcctgatgtatgtttccaggatttggattttgatttttcagatgtagcttgaaatttcaataaactttgctctgtttttctaaaaataaaaaaaaaaaaaaa

SEQ ID NO: 64 - protein, 77 aa, equine
MDLVKNHLMYAVREEVEILKEQIRELVEKNSQLERENTLLKTLASPEQLEKFQSCLSPEEPAPESPQVPEAPGGSAV

SEQ ID NO: 65 - DNA, 906 bp, equine
ctcagaaaatgcactcagacaccgtaatcagtggagctgcgatcttatgtacatttctactctaaaacctattttaaattttatcatctaccgcatgctatttcatctcctctcgtcctctcccccttgtatttattagaggctggctatggatttctgtccctgagagcaccttcctaacaatgaagtgtacttggcagtcgctcacggtgaataaggattggaggatattctgcaaggaaaatggatagccttgtttcctctgtatgagagaaatatttgaggtaaaatagactaataatttctcaaagtagaagttttgagggttgcttttgcatagagaagttggaaactccttgaagtgatagaaagcgtgtgggatattataattattgttatttcccgccctggcaggccgccgcgggttttctctttccgtgtgccagcatccttcgaggttcaaggccacttcatgtttttcttctgctttctccacactgactttttttgattttcatgaggggtctgagagagaaagcctcccagaacccactctcagtgcttccagccctcattctttgatggatgttcatgcaattttctcattatttttctgtcagcattcacagaaacagtgtaaagtactttatttcaaagccattatgttagtttactccataataatctaagctgtgtattccttttctgatttgaatttagtaataacatatttttaaagataagtcgaaaagatttcctgaataaattttcgatgacaactgcttaaggttcagttttttcccctcctttaatctctcttattggaccgcgggtttatctacttgatttaagttatcatttctttctgcacacttttaaaacaaaccctgtgaacttctcttggga

SEQ ID NO: 66 - DNA, 700 bp, equine
gcatgccccaacccaacccctggcccaagccacccccaaggggatgatccagaaactgcttgaaggcaagagtttctgaaaattctcttctctccctcctgtaaaggtttgcatattttaaattctgttctttccacaacccctcagcttctggatataatttgtgcataattgtgtatcctcctcaagattcatctccctcttccttctccaccctttcttcaggtggaattttctgggtgtctgatgtttacacttttccagacgagagttaaggggcccctcccattttctgtcagatcgtggatttcttttcctgtattgctttggaactgcaaaacagattcttctcaccgatggtagtgtagaaatcttcaggaaagatgtaaagattttttaaatgcctcaaagtgtggactttctagatggtcccaatatgtcagttgctgttctaaaaaaaaaatgtaaaaatcagatttcttagtttggtaggattaaaaattatttctggtgcagtattctttccgtgatatggcattggtggtcttgcctgtattttcaggtaagcttttggttgtgtatgtaactgaactttaaaatttccggtgcgttttatcggactgattcaatttagaggaagataaagggtgctgctctgaggctaggagatagtttttgaggtaaaaaaaaaaaaaaaaaa

SEQ ID NO: 67 - DNA, 1146 bp, equine
  CDS (28)..(1020)
gggggccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtctatgtaaatgacctccctgtaaatagtggggtcacccgaatcagctgtcagactttgatagtgaagaatgaaaatctaggaaatttggaggaaaaagaatattttggaattgtcactgtaaggattttagttcatgagtggcctatgacatctggttccagtttgcaactaattgtcattcaagaagaagtagtagagattgatggaaaacaagctcaacaaaaggatgtcactgaaattgatattttagttaagaaccagggagtaatcagacatacaaactacaccctgcctttggaagaaagcatgctgtactccatttcccgagacaatgacgttttgtttacccttcccaacctctccaaaaaagtagaaagtgttagttcgttgcagaccaccagccagtaccccatcaggagcgtggagaccaccgtagaaggagaggctctacctggcaaattacctgagactcctctcagagcagagcctccgtttccctataaggtgatgtgtcagtggatggagaggttcaggaaggacctgtgcaggttctggagcagcgtttgcccagtgttcttcatgtttttgaatgtcatggtggtcggaaatataggagcagctgtggtcataaccatcttaaaggtgcttttcccagtttgtgaatacaaaggaattcttcagttggataaagtgaatgttatacctgtgacagctatcaacgtacatccagatggtcctgagaaaacagtggaaaaccgtggagataaaacatgtgtttaaaacaccgtctcaaatcattgactttgaattagtcttttggctctaaatttgccacttgaatataattttctttaaatcattaagaatcagtttcaaaaaaaaaaaaaaaaaaaaaaaaaaaaa

SEQ ID NO: 68 - protein, 331 aa, equine
MEGAPPGSLALRLLLFVALPASGWLTTGAPEPPPLSGAPQDGIRINVTTLKDDGDISKQQVVLNITYESGQVYVNDLPVNSGVTRISCQTLIVKNENLGNLEEKEYFGIVTVRILVHEWPMTSGSSLQLIVIQEEVVEIDGKQAQQKDVTEIDILVKNQGVIRHTNYTLPLEESMLYSISRDNDVLFTLPNLSKKVESVSSLQTTSQYPIRSVETTVEGEALPGKLPETPLRAEPPFPYKVMCQWMERFRKDLCRFWSSVCPVFFMFLNVMVVGNIGAAVVITILKVLFPVCEYKGILQLDKVNVIPVTAINVHPDGPEKTVENRGDKTCV

SEQ ID NO: 69 - DNA, 2259 bp, equine
  CDS (59)..(1996)
ctcttgggttttttgtggcttccttcgttattggagccaggcctacacgccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgccgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaacaaaaaaaaaaaaaaa

SEQ ID NO: 70 - protein, 646 aa, equine
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 71 - DNA, 1795 bp, equine
  CDS (208)..(915)
taatagaaattaaaatgcttcttcatacatagctgaatagaaaagaatttgttgagaaggaattcagggtagcgaatattaggcataagcttgtagtttacttgtaacatctcaacactatcttttaactacaattaccaaaaactaggatccattattctttcacaaactaacaaattatattgctatcccaacagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaacaaaaatgaaaacattaatataaaccctgcaactcctgaagtagataaaaaagataactctacaagcatgcctgaaatagcaacatcagctcacattgtacccttaactcctaaatctcaaccggagctttatataccttctgttgtcaggaacagttctccaacagtacagagcattgaaaacacaagcaagagtcacagtgaaattttcaaaaaagatgtctgtgaggaaaactacaacaaaatcgctatgctagtttgtgtaattataattgcagtgctttttcttatctgtacccttctatttctatcaactgtggttctggcaaacaaagtctcatctctcagacgatcaaaacaagcaggcaaacgtcagcctagaagcaacggcgattttctggcaagcagtggtctatggcctgctgactcagatacttggaaaagagcaaaacagctcacagggccccacctaatgatgccatctactggagcactcacagctacaatggaaagaaaagatgaagaaagaactgaaaaactcactaactgatgctttagtgaagaaaaatgcaaagtggctatgagaaagtttagagtaaaaatgaagtcagtttgatatttaatgccaacaggttggtctgatggtctgaaatctgatgggcaggccttgcgatttaaaatgaagcaggtgagaaggggagaagcatgcctgcttacttaatgactgaaactgtgcacttttgttctgacactgaatatcttaaagagcaaataataaaacaaccaagcatctggggaaggttttgaagatgacttgaaggaactgactaatagaaagggtcaattaaataaatatttcctgttccataatagtagttagatgatctttgttcgaatgtaattaaattttgaaaagttttagcatgtccttagaggcaagtatatgcttcaacacctaacagaagtaaaaattctaatgcatagagatgaactgtatagtttaatggtaccttctttgctgaatgtgacagaatccataccagctcatgtatcaacacagctaattttaagcaggatgttttcatctttacatatggcacatataaaaaggtgcttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaataggctagtgtaaacgaaagtatgtttcactgtttatgattaataatattcatcttttctataaatactacttactggaacattaacaacaagtccaaaggttgattaattttgactcaggagcagagctatgattata

SEQ ID NO: 72 - protein, 236 aa, equine
MPTDMEHTGHYLHLAFLMTTVFSLSPGTKANYTRLWANSTSSWDSVIQNKTGRNKNENININPATPEVDKKDNSTSMPEIATSAHIVPLTPKSQPELYIPSVVRNSSPTVQSIENTSKSHSEIFKKDVCEENYNKIAMLVCVIIIAVLFLICTLLFLSTVVLANKVSSLRRSKQAGKRQPRSNGDFLASSGLWPADSDTWKRAKQLTGPHLMMPSTGALTATMERKDEERTEKLTN

SEQ ID NO: 73 - DNA, 1912 bp, equine
  CDS (14)..(1126)
cggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaacgacttgtggaggcctaggttggatgggaaaggctcgcggggtcaggtcccaccccgtctacccctccagtcagcccagcgcccatcctgcagctcagctgggagcactgccctcctgctttgtacatagggcgtgatcccctttcaccaggccaccaccatgtccaggcctgtgccaggaagccattgctcagttctacctttgtttttctcaacactacctttttgatacgaaggcagcaccttcggaatgtgaaatcatgtactgctcagaatgtgtccctctcatcaagtgctcattggtttaatggtgacgcctcctgtgcaggatctggtcacctgtgcatttgtgaacacccaggaattaggcagatcaccgtctcttgtctacccagtttaacaatttgtgataagatttgaccgtttctccctcaaataaatgtattggtgatttggaaaaaaaaaaaaaaaaaaaaaaaaaaaaa

SEQ ID NO: 74 - protein, 371 aa, equine
MAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 75 - DNA, 871 bp, equine
  misc_feature (31)..(31): n is a, c, g, or t
  misc_feature (41)..(41): n is a, c, g, or t
gaccacaactgaaatgtgcaactgtgcactnggggggattntggggagaaaaaaaaagcaggaaaaaatgtatctttaacagataagatctttttaacaaaaccatggtatcattgtcacttgccaaaattaatgatttccttaattagcatataataatcagtctgtattcagttttcctttcaaaaatatctttctgctggttgtttaaatgaggatccaacactgcatttagttgctgtctcttttactctataacattgacccctgtctttaatttctttcctcttcccagttatttgagaagggaactggatcatatatcctgtagaatttccttcgttcaggttttgactgacggtatccacatgatgtctagttagaactagaaggttgatttgattctggttcaaaaattttttccaagaatactccataggtgatgctatatactttcttttgcatcacgtcctgaggaacacgatgtctggttgttccactgttggtgatgtctggattgatcggtggtttctagtggtgtcatctactataaagcttcctatctatctttcacccaatggtttgagcaaccattgatgattgttacctgaatccattattttattaggggttgcaaaacagtgacttttggattctatcaaacctcttgcatttatcatctgtgattcttgtagaaagaagaactttgtctaaagctgattgggaaagatggaataaataattaatttattcatctttagaatgagttggtgccctaacaacctccaaaggtgataaatgaggtcttcgttttctaagtaggggtatgactaaaccagtactttgaaacagtgtgttttagaatgggctg

SEQ ID NO: 76 - DNA, 564 bp, equine
gaatattcgtgtacaagtgtcacgtggacatatttccatttctctcgtgtgtacacctagcagtggaaatgctgagtcatactgtaactccttcctcctaactttgcatatcaaagttatgttcggaactcagattcagtgctacttctatagtgttctgccatctcacactcagaacgaaactcccctctagtactcccagtgttgagtgcctcagtattgcgcttaccagtttgccctggagctgttattcctgcgtggctgttctcctcctactgtgaatttctggaaagcagggacaggctctcatttttgtctgtcccaagacagcgactgtaccgccctgcataaagcaggaactctgtaagtcctttcgaacgggtgggtaatacaagtgttaagaatttcatgtgcttgattctataaaatgtgtttaatattaaataataataatgttcactttcaaatttcaacaattaaatgtttgtcaaataacatttaaagtaaaggtgtataaggtaaaccagtttggtacattaaagtctattttattttaaaaaaaaa

SEQ ID NO: 77 - DNA, 495 bp, equine
  CDS (10)..(393)
gacgcagacatgcagatctttgtgaagaccctgacgggcaagaccatcaccctcgaggttgagcccagtgacaccattgagaatgttaaagctaaaatccaagacaaggagggcatcccacctgaccagcagcgtttgatttttgccggcaaacagctggaggacggccgcactctctcagactacaatatccagaaagagtccaccctgcacttggtgctccgcctgcggggcggcatcattgagccttccctccgccagctcgcccagaaatacaactgcgacaagatgatttgccgcaagtgttatgctcgcctgcaccctcgtgctgtcaactgccgcaagaagaagtgcggccacaccaacaacctgcgccccaagaagaaggtcaaataaggttgttctttccttgaagggcagcctcctgcccaggccccatggccctggggcctcaataaagtttccctttcattgactggaaaaaaaaaaaaaaaa

SEQ ID NO: 78 - protein, 128 aa, equine
MQIFVKTLTGKTITLEVEPSDTIENVKAKIQDKEGIPPDQQRLIFAGKQLEDGRTLSDYNIQKESTLHLVLRLRGGIIEPSLRQLAQKYNCDKMICRKCYARLHPRAVNCRKKKCGHTNNLRPKKKVK

SEQ ID NO: 79 - DNA, 3003 bp, equine
  CDS (337)..(1233)
ccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtgaaaaaaaaaaaaaaaaaaaaaaaaaaaaaaaaaaaaaa

SEQ ID NO: 80 - protein, 299 aa, equine
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 81 - DNA, 3400 bp, equine
  CDS (17)..(1906)
aaaatttgaagacaagatgggcacctactctacaattctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaaacaattgtttatatatagaatatggaatcaatgaaaaaatcacaatacccatcactcccgcttttttaggtcaacttagaagtggcagaagcatagagaaggtgtctttttacctgggatttcccattggaggcccacttgcttatgacattgaaattgtttaagagcctgatattcttcctccaagaatttgatctcagtacccatttaatttttttggactcaagatctatgctttaaaccggcaaggttatagatacagcctctagctcttcagatctgtacatgcagtatttaatttcctcttaaacatgttatgagttctacaaggacaatagtgaaaaaggaaggagtgagatatatgaaaagtagcaaatatgttccttggtttggttaacatcattgatgacaaaataataaggagctatgactggagtcaggagaagttagtgtaataagctggctacacagaaccccactacttaccaggcatggattgaagaagattgtctactcaaatggcatttagacattagaatgtctgggaaaatatttctcaaagacagcaaaaacctctcaaactgaggagcaacatttattcttactaagcagatcatcaatgtatcatgtgcttggcactcaaggatcttccaaaacagaggaccaaccagtcttctgaaggtcatgcccacagaagtcatcggaccttaccaaagtaggttggagaattagattgccttttcatgcagtgagattcagttaagcaaaaatgaaatttgtctctatagctaattagcttatcaactcccctccaaacaaacaattaaaaaaaaaacatacagacactcaaattccacaagctaatgaataaaaaggattcctgtgaaaaggctaatgagtcacccatccaggagatcccaacgtactagcaagtatacatataacctacacactgaacaagcacaatcactgagatgtaatcaaaatgtaattttccctaataaaattatggatatgggcaattgtcaatggttgccaaaaccattaagtggaaagctgattaaaaaacaaaaatttctaatggatttatcagactgtcctaaatcctgatcaatattaacactgcagagagacagccagacattgtgggcctcgaagtgctacaggagtgcacacatcacctggagatagtcttgccaaataattgaacctgaatctgatcaagcctctggatcttatttgcaattcaaaagaaattttaaaaaaatcctactaacaccaccacaaatatgcaatcagcaatatccagaaaggggaaattcacaggacaaaaacctggttttcttttttggtttcttcaaccaaaaaagaaagaaattgcaaaggaccaaaaaaatgttggggaatctatacattataagggacttaacaactaaagggcaacatatagactttagatcctaatttgagcaaaatctaaaatcaattattaggcaatcagaaaaatttgaacacagactagatatttgaggatattaaggtactatattattgaagattccatggttatgttttttaaagagttcatgccttttagagatacatactaaagtatttgtaaataaatgacatgatctagaaaaaaaaaaaaaaaa

SEQ ID NO: 82 - protein, 630 aa, equine
MGTYSTILIKTEVIECGNYCGVRIIHSLIAEFSLEELKKSYHLNKSQIMLDMLTENLFFDTGMGKSKFLQDMHTLLLTRHRDEHEGETGNWFSPFIEALHKDEGNEAVEAVLLESIHRFNPNAFICQALARHFYIKKKDFGNALNWAKQAKIIEPDNSYISDTLGQVYKSKIRWWIEENGGNGNISVDDLIALLDLAEHASSAFKESQQQSEDREYEVKERLYPKSKRRYDTYNIAGYQGEIEVGLYTIQILQLIPFFDNKNELSKRYMVNFVSGSSDIPGDPNNEYKLALKNYIPYLTKLKFSLKKSFDFFDEYFVLLKPRNNIKQNEEAKTRRKVAGYFKKYVDIFCLLEESQNNTGLGSKFSEPLQVERCRRNLVALKADKFSGLLEYLIKSQEDAISTMKCIVNEYTFLLEQCTVKIQSKEKLNFILANIILSCIQPTSRLVKPVEKLKDQLREVLQPIGLTYQFSEPYFLASLLFWPENQQLDQHSEQMKEYAQALKNSFKGQYKHMHRTKQPIAYFFLGKGKRLERLVHKGKIDQCFKKTPDINSLWQSGDVWKEEKVQELLLRLQGRAENNCLYIEYGINEKITIPITPAFLGQLRSGRSIEKVSFYLGFPIGGPLAYDIEIV

SEQ ID NO: 83 - DNA, 788 bp, equine
ctcacacagtagccatagtggtctttctaaaggcttaatcagagtagatcatttctttgcttaaaacctttcaacggttttctgttacgctaagaataaaaacccaaactcttaagtatagccagcaaggccccacttccctggctgtctctctgactcctttgcgtcctgcttactgtgcttcagccacgctggcttccttgctgctgatcctgcttgatcaccagcttgatcctgtcccgctggtgtactccaagataactggtcagttggtcctgtcccaggggctttgtccttctgtcttctttttcagtctgcttcccctagatgctcgccagctgcttccttttccctgttctagtctcaactcaaaggtcactgtgctagagaagctttcttcagccacccagcagatcagcaccctcttcatcactgtccaccacagtgtctttctctgtcttcctcatggctctcaaactgtcttattcgttattgatgggttttttttcatctttctgtccccattaacatataagctttttaagagcagagactttcttttcaccacgcctaaaacaggacctaccacatattgaatgttgaacagatatttattgactgactagtaaaaatgcatctttgaacttaaaatgaatgtgttttgtgaagtatggcaaaagccaatttgggagtatttgtgctttaaatttcaaaagttgcaaatacaggctgtgttgaaggcattttaggaatcagacagactctgggaatttaaatcgttgttctgc

SEQ ID NO: 84 - DNA, 582 bp, equine
agtgtaggagttcagtagggatgtgtattttaatgtgcacctattttagggcattgacatacagagtgaagcaaggtggccacctattttattgtgagctcttcctaggaaggctcctatttcagcagtttggtctggctaactttaaatggaacagctaagctgacgttggcaggcattcaaattcatgtctccttggggccaatctgttctattttgtgccatgaaacttcagctgttgagcaaagagcaacttagctgtctcatcccaaaaatctagaacaagtctaaagatctatgcagaagagtgggaaggtaaattatggtatctccttaggacagaattttatgaatttattgaaagatataggaaagaagcatttaagaagtctagaggaggggctggccttgtggcatagtggttaagtttagtgcactccccttcagtgacccgggttcacagatttggatcctggatgcagacctaggccagtcatcagccatgctgatgacccacatgcaaataaaggaagattggcacagatgttagctcagggctaatcttcctcagcaaaaaaaaaa

SEQ ID NO: 85 - DNA, 4001 bp, equine
  CDS (197)..(2443)
attaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacgttcacgtgggtggagcgctcccagaacggaggagagccttactttcatgcggtcgaaccctacacgaagaaagaactttctgctgttacttttcctgatatcattcgcaattacaaagtcatggctgctgaaaatattccagagaatcccctgaagtatctgtatccaaatattgataaggaccatgccttcggaaagtattactccaggcccaaggaagctccagaaccaatggaacttgatggccctaaaggaactggatacatcaagactgaattgatttctgtgtctgaagttcacccttctcgacttcagactacagacaaccttcttcccatgtctcctgaggagtttgacgaggtgtctcgcatagtgggctctgtggaattcgacatgatgaacgcagtatagagcatgaattttactcatcttccctggcgacatttttccctcccatctgtgattccctcctgctggtctgttccttcacatcctgtgtttctagggaaaggaaagcaaggctgacaaatttgctgcaacctgttgatagcaagtggatttttccctcattcagaaacatctgttactctgaagggcttcatgcatcttattaaaggtaaaattgagagaccctctccacagagtgggtttgacaaacgaacaacattcagatacacccacaacctcaggactagagtgcgagtccctcgggaaaggggagaagtcgagcagcgtgtggcaaatactatgcataaagtcagtgcccaacggttatgggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagcttttctgtttgttatgggtttatgatactggctaatatcaatagaaggaagtaccttttccaaattcacaagttgtgtttgatatccaaagctgaatacattctgctttcatcttggtcacatacaattatttttacagttctcccaagggagttaggctattcacaaccactcattcaaaaagttgaaattaatcatagatgtagacaaactcaaatctaattcatgttttttaaatgggttaatttgtctttattgttattagctggtatttagtctattagccacaaaattgggaaaggagtagaaaaagcagtaactgacaacttgaataatacaccagagataatatgagaatcagatcatttcaaaactcatttcctatgtaactgcattaagaattgcatatttttcactgataaatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatcgacacagtgctttccgtggcactgcatacaatctgaggcctcctctctcagtttttatatagatggcgagaacctaagtttcagttgattttacaattgaaatgactaaaaaacaaagaagacaacattaaaaacaatattgtttcta

SEQ ID NO: 86 - protein, 749 aa, equine
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPYFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDMMNAV

SEQ ID NO: 87 - DNA, 1326 bp, equine
  CDS (1)..(951)
atggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccaggaggtcgggtgtgcaatgtgtcagcagagcgtgccgaagcactcgctggagcttcatgaggccacggaatgcagggaccgccccgttgcgtgtcagttctgtgagctggccgtgcgcctcagtaaggcagagatccatgagtaccactgtggcagccggactcagctctgcccagactgcgaccagcccatcatgctccgagcgctggcccagcacaaggacgtgtgtcagggcaaacaggcccagcttgggaaagggaaggaaatttcagctcctgaatgcaaattcagctgttggtattgcaacgaaatgattccaggagataagtattcccaccacgtggataaatgtcgcacagtctcagagtctgtgaaatattttccagttggaaagccaagaattcctcctccatcccttccaagccaggctgctgaagatcaatcttccacggcagagaaagatgtccgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtctcgccacagcaatcaggcaagagaaagaagtaaaaggcaccc

SEQ ID NO: 88 - protein, 317 aa, equine
MEGDFSVCRNCKRHVVSANFTLHEAYCLRFLVLCPECEEPVPKETMEEHCKLEHQEVGCAMCQQSVPKHSLELHEATECRDRPVACQFCELAVRLSKAEIHEYHCGSRTQLCPDCDQPIMLRALAQHKDVCQGKQAQLGKGKEISAPECKFSCWYCNEMIPGDKYSHHVDKCRTVSESVKYFPVGKPRIPPPSLPSQAAEDQSSTAEKDVRPKTRSINRFPLHSESSSKKAPRSKNKTLDPLLMSEPKPRTSSPRGDKAAYDILRRCSQCGILLPLPILNQHQEKCRWLASSKRKTSEKFQLDLEKERYYKFKRFHF

SEQ ID NO: 89 - DNA, 1819 bp, equine
  CDS (1)..(1716)
atggggatggggatgctgaggcccagtggaatcccccggccccaagatgccagcagggacggctgtccttgtcccatcctccagctctccccgatggaggcctcagccgagttcgtggtcgagagccccgacgtggtctacggccccagacgccatcgaggctcagtgtaccccacgtccacgcgcttcacctttcggaccgcccggcaggtgccccggctcggggtcatgctcgtcggctggggcgggaacaacggctccacgctcaccgccgccgtgctggccaaccggctgcgcctgtcctggcccacgcgcaccggccgcaaggaggccaactactacggctcgctgacgcaggcgggcaccgttagcctgggcttggacgccgagggccaggaggtgttcgtgcccttcagcgcactgctgcccatggtggcacccgacgacctcgtgttcgacggctgggacatatcgtcgctgaacctggctgaggcgatgaggcgtgcacaggtgctggactgggggctgcaggagcaactgtggccacacttggaggctctgcgccctcggccctccgtctacatccccgaattcatcgcagccaaccagagtgtgcgagctgacaatctcatactgtgcacgcgcgcacagcagctggagcagatccgtagggacatccgtgacttccgatccagtgctgggctagacaaagtcatcgtgctgtggaccgcaaacacggagcgcttctgcgaagtcatccccggcctcaatgatactgctgagaacctgctgcgtaccatccagctgggcctggaggtgtcgccctccactctttttgctgtggccagcatcttggagggctgtgccttcctcaacgggtccccgcagaacacgctggtgcctggggcgcttgagctcgcccgtcagcgacgtgtcttcgtgggtggagatgacttcaagtcaggccaaaccaaggtcaagtccgtgctggtggacttccttatcggctctggcctcaagaccatgtccatcgtgagctacaaccacctgggcaacaatgacgggcagaacctgtcggcaccgccgcagttccgttccaaggaggtgtccaagagcagcgtggtagacgacatggtgcagagcaaccctgtgctctatgcacccggcgaggagcccgaccactgtgtggtcatcaagtacgtgccatacgtgggcgacagcaagcgtgcgttggatgagtacacctcggagctgatgctgggcggcaccaacacgctggtgctgcacaacacctgtgaggactccctcctggccgcacccatcatgctggacctggtgctgctgaccgagctgtgccagcgcgtgagcttctgcaccgatgccgacccagagccgcagggcttccactccgtgctgtccctgctcagcttcctattcaaggcgccactcgtgccgccgggcagccctgtggtcaatgccctcttccgccagcgcagctgcatcgagaatatcctcagggcctgtgtggggctccccccacagaaccacatgcttctggagcacaagatggagcgccctggcctcaagcgagtggggcctatggttgctgcctgccctgtgccctgcaagaaaggaccagcgccaactgcccccaatggctgtacgggtgatgccaatgggcactcgcaggctgaggcaccccagatgcccaccacttaaggccatggccatccttctccccccaaactgttgcctctgttgcccctcaggacccaacccttccaagaccctaaagacaataaaaccagtgctacaatca

SEQ ID NO: 90 - protein, 572 aa, equine
MGMGMLRPSGIPRPQDASRDGCPCPILQLSPMEASAEFVVESPDVVYGPRRHRGSVYPTSTRFTFRTARQVPRLGVMLVGWGGNNGSTLTAAVLANRLRLSWPTRTGRKEANYYGSLTQAGTVSLGLDAEGQEVFVPFSALLPMVAPDDLVFDGWDISSLNLAEAMRRAQVLDWGLQEQLWPHLEALRPRPSVYIPEFIAANQSVRADNLILCTRAQQLEQIRRDIRDFRSSAGLDKVIVLWTANTERFCEVIPGLNDTAENLLRTIQLGLEVSPSTLFAVASILEGCAFLNGSPQNTLVPGALELARQRRVFVGGDDFKSGQTKVKSVLVDFLIGSGLKTMSIVSYNHLGNNDGQNLSAPPQFRSKEVSKSSVVDDMVQSNPVLYAPGEEPDHCVVIKYVPYVGDSKRALDEYTSELMLGGTNTLVLHNTCEDSLLAAPIMLDLVLLTELCQRVSFCTDADPEPQGFHSVLSLLSFLFKAPLVPPGSPVVNALFRQRSCIENILRACVGLPPQNHMLLEHKMERPGLKRVGPMVAACPVPCKKGPAPTAPNGCTGDANGHSQAEAPQMPTT

SEQ ID NO: 91 - DNA, 1546 bp, equine
  CDS (199)..(639)
ggggacactcgcgcacactcgcgctcgggcgcacacggagcagggaccggcgcccggagcgagccagggagcggctaaccggggacccaccgcgcggagccagcctagctgccagcgagcccaacccgcgacgacccacgcccctgagccccgcagccgacccctgccggccggtgtccccaccgccatccctgacccatggcgctgaagaggattcagaaagaattgagtgatctacagcgcgatccacctgctcactgttcagctggacctgtgggagatgacttgttccactggcaagccactattatggggcctcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctactatttgtcttgattacttaaaaaaataaaaatataagtaaggattaaaaaaaaaaaaaaaaaaaaaaaaaaaaaa

SEQ ID NO: 92 - protein, 147 aa, equine
MALKRIQKELSDLQRDPPAHCSAGPVGDDLFHWQATIMGPPDSAYQGGVFFLTVHFPTDYPFKPPKIAFTTKIYHPNINSNGSICLDILRSQWSPALTVSKVLLSICSLLCDPNPDDPLVPDIAQIYKSDKEKYNRHAREWTQKYAM

SEQ ID NO: 93 - DNA, 640 bp, equine
agtcctctcgatgaagcttcttcccacctagaaagaagtcctctctgagactcaagggctaaggcaaggtcttccagaaaacaaggctttgactccaagaacagaggtgatggggagacttcttggctcggcggggaaaggaggacgccaatgggtcaaactaactctgaatccctccctccatctctctttttccactgtcgtcagagccaacaagaaatgacagcctccaagccttcctaaaagcacacttgcccccgcctgccacctctcctcaggctgctgccctcccaggcgctccacagcgaaggggtgtggtgtttcctgcaggccaggccagctgcctcagccccgccaaaactgtgttcccagccagcgctctggagcagggatgacgtgtggccagcccttctcaggtctcagctctgctgggatgggaggagaggccagggagaaaggttaggggcccaggggtgggtgacaacgctggctgctgaaagcccatgagctgcttctttgttctctgtcacgggacaaaaatctctcatcctattctgctttcagttcattaagagagcacattttactcatacacaaataaaagttttcccttgtggaaacaacagctttaaaagaaagg

SEQ ID NO: 94 - DNA, 1413 bp, equine
  CDS (90)..(1064)
agggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggccgcggccaaggaggactacgtgctggtggctggccactacccaatatggtccatcgcggagcacgggcccacccactgcctcgtcaagcagctgctgccactgctggccatgcacaaggtcaccgcctacctgtgtggccacgaccacaacctgcagtaccttcaagacgagaacggcataggctttgtgctaagcggcgctgggaacttcatggacccctcgacgaagcacgcacgcaaggtccccaatggctacctgcgcttccaccacgggaccaacacctccatgggtggctttgcctacgtggagatcagccccaaagagatgaccgtcacttacatcgaagcttcgggcaagtccctgttcaagaccaggctgcccaggagagcaaggccctgaactcccatgactgcccagctctgaggcccgatctccactgttgggtgggtggcctgccgggaccctgctcacaggcaggcttttcctccaacctgtggcgctgcagcagggcaggaaggggaaacacagctgatgaactgtggtgccacgtggcccttgtggcaaggatgcccacggatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctg

SEQ ID NO: 95 - protein, 325 aa, equine
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAKEDYVLVAGHYPIWSIAEHGPTHCLVKQLLPLLAMHKVTAYLCGHDHNLQYLQDENGIGFVLSGAGNFMDPSTKHARKVPNGYLRFHHGTNTSMGGFAYVEISPKEMTVTYIEASGKSLFKTRLPRRARP

SEQ ID NO: 96 - DNA, 1092 bp, equine
  CDS (96)..(1046)
ctgcaaggcggcggcaggagaggttgtggtgctagtttctctaagccatccagtgccatcctcgtcgctgcagcgacaccgctctcgccgccgccatgactgagcagatgacccttcgtggcaccctcaagggccacaacggctgggtaacccagatcgctaccaccccgcagttcccagacatgatactgtcggcctcgcgagacaagaccatcatcatgtggaagctgaccagggatgagaccaactacggcatcccacagcgtgctcttcgaggtcactcccactttgttagtgacgtggtgatctcttcagatggccagtttgccctctcaggctcctgggatggaacgcttcgcctctgggatctcacaacgggcaccaccacacgccgatttgtgggccataccaaggatgtgctgagtgtggcattctcctctgacaaccggcagattgtctctggctcccgagataaaaccatcaagctatggaatactctgggtgtatgcaaatacactgtccaggatgagagccactcggagtgggtgtcttgtgtccgcttctcacccaacagtagcaatcccatcattgtctcctgtggctgggacaagctagtcaaggtgtggaatttggcaaactgcaagctgaagaccaatcacatcggccacacaggctacctgaacactgtcactgtctctccggatggatccctctgtgcttctggaggcaaggatggccaggccatgctttgggatttaaatgaaggcaagcacctttacacactagatggtggggacatcatcaacgccttgtgcttcagtcccaatcgctactggctctgtgctgccacaggccccagcatcaagatctgggacttggagggcaagatcattgtagatgaactgaagcaagaagttatcagtaccagcagcaaggcagagccaccccagtgcacttctcttgcctggtctgctgatggccagactctgtttgctggctacacggacaacctggtgagagtgtggcaggtgaccatcggcacccgctagaaatacatggcaagctttagaaataaaaaaaaaatggcttttc

SEQ ID NO: 97 - protein, 317 aa, equine [sequence omitted]

SEQ ID NO: 98 - DNA, 487 bp, equine
gattccggatgagccacccagcccttctggccctgctgtggctcgcccaaaagtcgcccaagaagaaaggatcactccagcatccagtgacaacctgaacccccaaataaaagtcaaagaagacactcaagaaatgccctgtgctccctcaggcccagtgcaagtgatacgagatgattctcctgaaccaaatgatgcagaagagccccaggaggcatccagcacacctcccacaaagaaaggaaagaaaagaaaaagaaatgtgtggtcaattccaaagaagagatatcataaaaaaagcctcccaaaagggacagtctcacctggggatgaaatccaagagaagctccaagtggtggatcaggcaactcaaaagaaggacgactcaaccaggaactcaaaggtcacgacaagggtccaaaaagccaggactggatgtgcccaaacatctggaccagaggaggtcagtgatgacgcttcagaagtg

SEQ ID NO: 99 - DNA, 492 bp, equine
gaccttgatgtttggatgattacaaaccaaaagtgtcagaaatagagtactctgatttgaaaagcaaatatggtactgaaatagacaagaacagtatgtgaaagggctagaagatcatccttggttgaacattaagtatacctcaattcaacatgctcactatcagtagcagcagaatggaacaattgtttgaactgagctttgtctctgcagcacctccctccaggtcaaaatggcagtcatccattggctgcaccagctgttcctcctcacccttctttatgtgcttagatacgtgctccagacacaagtcccattcatgagcttcctgttagatgtgaacctccagcagaggcaacgcttcctctcccatcttgccctgaaggctggcctgccccttggctggattcattcaaagttgataaagcaatggtcctcaattctgtttattggtaaaccatcttttccatgctgatttgaaacacgttagat

SEQ ID NO: 100 - DNA, 947 bp, equine
  misc_feature (727)..(727): n is a, c, g, or t
gacaatgtttgtgcttgattgctcctttaaatccagcgtgccattgattctgcatgcccacctcatcctggccttcctgatggaaataggttaagagaaccagtcctgtcttcaccctcgagagaaacttaggtgaggctggtcagttcagtgctttcttagtgcatgtctgctgtatgtttctggcacccatgcccaaccaggtttttagagatttcagacatcttaaagatgcaaatgcttcccagcatttttgtttgtgtagccctgcttgctttagcgtatgcttgaataaaaagcattgcagctaaggcagctgtaagaaaaaggtacttcttcagaagtaagcaactcatctttaaagcaccctcaaatgaattttgtttttccttcttatgttgaggtagagtcaaaatagatggtgttttattttttgctgtttgggttaccagctctgtggactctccgaccttcccttcccagttcacacatttccattaggatgcagcctgctggatgtatgcatttcaccccgagtccatcggtcagccagtacacattgagtgcctgctttcagtcaaggcagctgatgtgaggggctcatcgtgttggcagcaatatcccagcagcagtctttttctattctccctgtcttggatgctccggggggtatcaggcatcttggctgcttgaagcctgggccctcagccctttgcattctccttanagaggaggcctgctgcccttctctttctgggtcggaacttctcattcttggcatgtttctggactacatgcatatgggcagctattcattaatctgcagaacccaatgtcagccatccatgatgtctggagcgggtagcattcgtttcaaagaagcctcgtttctcggggagggcgattctgtctatactttgaagggggtgtatttacccccatacccc

SEQ ID NO: 101 - DNA, 634 bp, equine
ctcaaacccaagccaagggtaatttttacttgaaactaggagagtggggaagacactagagagaaggggtgagtcgtgcaggtgggccacctgcccctggtgtctgtccacgtcactgagtgctgtgagccagtgcctttcctgcacctgaacatggagcccgctcttcccgcctgggtgaagagacctcgctgcccaggggtagaccttgaagaaggtgtcttggagagcccagaggacactcacgtattcaggtgcccattttaagcatctttaaaatattttatagataaaagcatgccctttcctgtcggtgccaccagtggtgcagttccatccattctgaatggaaaagtggagcctgccagtgctttcctgggtcactccttcatctcccttgatgtggtgtcccctccccctcccgtccatttcactgtcgtggctggatagcagagggcaccatgtagtcctgacgcagtcctgtgtgattccgtgatcagttttttctgtaactgtccttccaaaccagttgatgtttggaaattagggaaaaaattaaattctcaccaatggttgctgttacagttaaatcaataaagatcttgagtatcaaaaaaaaaaaaaaaaaaaaaaa

SEQ ID NO: 102 - DNA, 1324 bp, equine
  CDS (148)..(486)
cggcacgagcgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaaaaaaaaaaaaaaaaaaa

SEQ ID NO: 103 - protein, 113 aa, equine
MSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 104 - DNA, 1074 bp, equine
  CDS (1)..(1071)
atggccacaccggcggtaccagtaagtgctcctccggccacgccaaccccagtcccggcggcggccccagcctcagttccagcgccaacgccagcaccggctgcggctccggttcccgctgcggctccagcctcatcctcagacccggcggcagcggcgactgcgaccgcggctcccggccagcccccggcctcggcgccagccccagcgcagaccccggcgcagtctttgccgggtcctgctctcccgggccccttccccggcggccgcgtggtccgcctgcacccggtcattttggcctccatcgtggacagctacgagcgacgcaacgagggcgctgcccgcgttatcgggaccctgctcggaaccggtgacaagcactctgtggaagtcaccaattgcttttcagtgccacacaacgagtcagaagatgaggtggctgttgacatggaatttgctaagaacatgtatgaattgcacaagaaggtctctccaaatgagctcatcctgggctggtacgctacgggccatgacatcacagagcactctgtgctgatccatgagtactacagccgggaagcccccaaccccattcacctcactgtggacacgagcctccagaacggccgcatgagcatcaaggcctatgtcagcactttaatgggtgtccctgggaggaccatgggggtgatgttcacacctctgacagtgaaatatgcatattatgacacagaacgcatcggagttgacctgatcatgaagacctgttttagccccaaccgggtgatcggactctcaagtgacttgcagcaagtaggaggggcgtcggctcgcatccaggatgccctaagcacagtgttgcagtacgcagaggatgtactgtctggaaaggtgtcagctgacaatacagtgggccgcttcttgatgagtctggttaaccaagtacccaagatagttcctgatgacttcgagaccatgctcaacagcaacatcaatgacctgctgatggtgacctacttggccaatctcacacaatcacaaattgccctcaatgagaaactcgtaaacctgtag

SEQ ID NO: 105 - protein, 357 aa, equine
MATPAVPVSAPPATPTPVPAAAPASVPAPTPAPAAAPVPAAAPASSSDPAAAATATAAPGQPPASAPAPAQTPAQSLPGPALPGPFPGGRVVRLHPVILASIVDSYERRNEGAARVIGTLLGTGDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 106 - DNA, 942 bp, equine
tccccaggctgccgaagcggagtgcacgaacttaactgctgcaccaccaggctggccccttgatccatttcttttttcttttttgaagaagattatccctgagctaacatccaccaccaatcctcctctttttgctgaggaagactggtcctgagctaacatccatgcccatcctcctctactttatatatgggacgcctaccacagcatggcttgccaagtggtgccatatgggcacctgggatccgaactggcgaaccctgggccgccgaagcggaacatgcgctcttaactgctgcgccacccggccggcccctatatgtttcttgacagggtagataatttgtttagggaactacaattctgttctttaactatgtaccataaagaatgtgattaaagtacttgaaaagtaacttcttcaaacttagttttttataaaatatgcagatctaaaagtcactgtcaagataagtctgaattagttctcttatggtcctacttctaaaactgaaggttttgtgtgcaaaggaatcctttctggataagacgggattccctttaccctctgtccacggggctttatgttaactgtgaggccgcatgtgtccgtcactggcaccccggtcccaccgggatgtgtgggagcctccaggctgtcccagtgttaattgtatttacagcaggcctactagaccagcaggaagcatcgcacatgtcacattgcacatgggagctcaggtcctgaagtcaggcttctgtctgtgctgtccttcctgtttgtgggttgctggttctccactggggtccttcaaaagcagccccacccacacctccccattctattcactctgctgcctgtgttaatatttctaaaagatttttaatacattaaactcttacctacgattactgtggaatgggatatactgttaattagaa

SEQ ID NO: 107 - DNA, 642 bp, equine
tctgttctttaactatgtaccataaagaatgtgattaaagtacttgaaaagtaacttcttcaaacttagttttttataaaatatgcagatctaaaagtcactgtcaagataagtctgaattagttctcttatggtcctacttctaaaactgaaggttttgtgtgcaaaggaatcctttctggataagacgggattccctttaccctctgtccacggggctttatgttaactgtgaggccgcatgtgtccgtcactggcaccccggtcccaccgggatgtgtgggagcctccaggctgtcccagtgttaattgtatttacagcaggcctactagaccagcaggaagcatcgcacatgtcacattgcacatgggagctcaggtcctgaagtcaggcttctgtctgtgctgtccttcctgtttgtgggttgctggttctccactggggtccttcagaagcagccccacccacacctccccattctattcactctgctgcctgtgttaatatttctaaaagatttttaatacattaaactcttacctacgattactgtggaatgggatatactgttaattagaaatatatttttatttaaaaaaattatattcagaatacaactagaatagaccaaaaaaaaaaaa

SEQ ID NO: 108 - DNA, 681 bp, equine
gggagccctcacagggcttcagtgtaagggggactgagccatcgaaagctcattgccagaaggataccatttttggctctccctcttcactaccagtacacagtttgacccagtggccactggttcacagtacgccacgtcactgccatcccatgaaacagtttgttcccaggccgtgcagaatcctggagtggcatgctgaccagaatggcttgcttctgcagaggatgctgccccgtgacttagctgctgcctccagcttcttgcttaagaacttactaaagggacttccttcccattaaaaccccaatagcaactctccctaaatttgttgattctctgctaggcctgagaatctgaattaacatctcttgaagccaaactccgcctcttgtgctttttttgctttggataaaggagtttttctttagaaacagtgccaagaatgacaagatataaaaaactaattttaaagaaaatgcctaacaggtttttaatacagtaatcactgtaattatcactttcttttctagttccttggttttcagctcaggctgcattctctaactcatactgtgaagaaagaggtgtttttgattcagaaatatatgaaatctacatagtcttaatttgtaaaaaataaagaaaattccttaacctttaaaaaaaaaaaaaaaaaaa

SEQ ID NO: 109 - DNA, 2116 bp, equine
  CDS (157)..(1929)
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaactgcactacgtgacagagctgacagagcgaatcagggcaaaatcctcacccagtaacagtgagcttgaagactcagctgacttcgtgagcttctttccaacctttgtgtggactctgagagatttctccctggagctagaagccaatggagaacccatcactgctgacgagtacctggagctgtcactgaagctaaagaaaggtactgatgaaaaaagcaaaagctttaatgaacctcggttgtgcatccgaaagttcttcccaaagaagaagtgcttcatctttgaccgtcccgctcccaggaagtaccttgtccaactggagaagctacaggaggaagatctggaccctgaattcagagaacaagttgcagacttctgctcctacatcttcagccattccaaagccaagactctctcaggcggcatcatagtcaatgggcctcgtctggagagcctggtgctgacctatgtcaatgccatcagcagtggggatcttccctgcatggagaatgcagtcctggccttggcccagatagagaactcggccgcagtacaaaaggccgtggcccactatgatcagcagatgggccagagggtgaagctgcccacggaaaccctccaggagcttctggacctgcacagggccaacgagaaagaggccattgaagtcttcatgaaaaattctttcaaggatgtggaacaaaagttccagaaggaattaggggcccagttagaagcaaagcgagatgacttttgtaagcagaacatgcaagcgtcatcagatcgttgcatggcattacttcaggatatttttggtcctctagaagaagaggtgaagcaaggggcattttctaaaccgggaggttatcatctctttattcagaagaaacaggagctgaagaataagtactaccaggtgcccaggaaggggatacaggcagaggacatgctgaagaagtacttggaatccaaggaagacgtggctgatgcgcttctccggactgaccagtcactctcagaaaaggaaaaggagattgaagtggaacgtataaaggctgaatctgcagaagctgcaacgaaaatgttggaggaaatccaaaagaagaatcagcagatgatggaacagaaagaaaagagttatcaggaacacgtgaaacaattgactgagaagatggagagagatagggcccagctgctggcagagcaggagaggactctcgctcttaaacttcaggaacaggaacgacttctcaaggaaggattccagaacgagagcaggaaacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcttccatttttgttgagctataaaatttgcaaagtttgcaaagtaaaggttaagtatgaggtcaatgtttt

SEQ ID NO: 110 - protein, 591 aa, equine
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTERIRAKSSPSNSELEDSADFVSFFPTFVWTLRDFSLELEANGEPITADEYLELSLKLKKGTDEKSKSFNEPRLCIRKFFPKKKCFIFDRPAPRKYLVQLEKLQEEDLDPEFREQVADFCSYIFSHSKAKTLSGGIIVNGPRLESLVLTYVNAISSGDLPCMENAVLALAQIENSAAVQKAVAHYDQQMGQRVKLPTETLQELLDLHRANEKEAIEVFMKNSFKDVEQKFQKELGAQLEAKRDDFCKQNMQASSDRCMALLQDIFGPLEEEVKQGAFSKPGGYHLFIQKKQELKNKYYQVPRKGIQAEDMLKKYLESKEDVADALLRTDQSLSEKEKEIEVERIKAESAEAATKMLEEIQKKNQQMMEQKEKSYQEHVKQLTEKMERDRAQLLAEQERTLALKLQEQERLLKEGFQNESRKLQKDIWDIQMRSKSLEPICNIL

SEQ ID NO: 111 - DNA, 1566 bp, equine
  CDS (170)..(964)
gggtgattggtacagtaggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgtcttctgctgctgactggactgggagtcttaggaagcatgttttatataactttgaagacagaagtgggaaaattgaatgaactacaaaattttaaagaagaacttcagagaaatatttctatacaactgatgcataacatgaataattctgagaagatcaggaacctctctatcacactgcaagaaatagccaccaaattttgtcatgagctgtatagaaacaatcaagagcacaaatgtaaaccttgcccaaagcaatggatatggcatgaagacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaacaaagaatgatatgtgagaagatggccaatccagtgcagcttggttctacatattttagggaggcatgaggcatcaatcaaatacattgaaggagtgtagggggtgggggttctaggctataggtaaatttaaatattttctggttgacaattagttgagtttgtctgaagacctgggattttatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagttgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggcaaaaaaaaaaaaaaaaaaaaaaaaaaaaaaaa

SEQ ID NO: 112 - protein, 265 aa, equine
MSEEVTYADLQFQNSSEMEKIPEIGKFGEKAPPAPSHVWRPAALFLTLLCLLLLTGLGVLGSMFYITLKTEVGKLNELQNFKEELQRNISIQLMHNMNNSEKIRNLSITLQEIATKFCHELYRNNQEHKCKPCPKQWIWHEDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKQRMICEKMANPVQLGSTYFREA

SEQ ID NO: 113 - DNA, 1970 bp, equine
  CDS (16)..(1572)
ggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgcgtctggaggatgcctctctttgaccattatactagacaggttgtcgattgccaacttgctgatgttaataacatcggaaagtatagatctgcaggagcatgtacagctgcagcattcctgaaggaatttgtgactcatcctaagtgggcgcatttagacatagcaggagtgatgactaacaaagatgagattccgtatctgcgtaaaggcatgaccgggaggcccacgaggaccctgatagagttcttgcttcggttcagtcaagacaaagcttagttcagatactctaaaatgccttcattctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaattttttaaaaactacctaatcatttttcagagtgtatgtttttaattgagtgaaattgtatttcggatttgtgatgctaggaacatgagcaaactgaaaattactatgcacttgtcagaaacaataaatgcaacttgttgtgcaaaaaaaaaaaaaaaaaaa

SEQ ID NO: 114 - protein, 519 aa, equine
MFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFDHYTRQVVDCQLADVNNIGKYRSAGACTAAAFLKEFVTHPKWAHLDIAGVMTNKDEIPYLRKGMTGRPTRTLIEFLLRFSQDKA

SEQ ID NO: 115 - DNA, 25 bp, equine
caacgtgttgagatcattgccacaa

SEQ ID NO: 116 - DNA, 25 bp, equine
gaatccagagtccaagaccgtcaag

SEQ ID NO: 117 - DNA, 25 bp, equine
ggtctaaaagatctcctcgaacact

SEQ ID NO: 118 - DNA, 25 bp, equine
ggtactactgatacggatggcccaa

SEQ ID NO: 119 - DNA, 25 bp, equine
gccatcatttccctgcatacagtat

SEQ ID NO: 120 - DNA, 25 bp, equine
atatgtcaagccctaattgtccccg

SEQ ID NO: 121 - DNA, 25 bp, equine
taattgtccccggattgcagttctc

SEQ ID NO: 122 - DNA, 25 bp, equine
gttctcctaagatgaccaaccagtc

SEQ ID NO: 123 - DNA, 25 bp, equine
aattagctgctactactcctgcagg

SEQ ID NO: 124 - DNA, 25 bp, equine
atggttcatcatcctgagctgttca

SEQ ID NO: 125 - DNA, 25 bp, equine
tcagtagtaactctgccttggcact

SEQ ID NO: 126 - DNA, 25 bp, equine
gaaagatcttcactccatggacttc

SEQ ID NO: 127 - DNA, 25 bp, equine
tcactccatggacttctactgccat

SEQ ID NO: 128 - DNA, 25 bp, equine
aaggagcccatattcttccaatggt

SEQ ID NO: 129 - DNA, 25 bp, equine
ttcttccaatggttatatacacaaa

SEQ ID NO: 130 - DNA, 25 bp, equine
gaagtcttagatgtacatatttctt

SEQ ID NO: 131 - DNA, 25 bp, equine
catatttcttacattgttttcagtg

SEQ ID NO: 132 - DNA, 25 bp, equine
gtgtttatggaataacttacgtgat

SEQ ID NO: 133 - DNA, 25 bp, equine
gtactacacatgaatgaccaatagg

SEQ ID NO: 134 - DNA, 25 bp, equine
gaaatctagatatatgttctgcatg

SEQ ID NO: 135 - DNA, 25 bp, equine
atatgttctgcatgatatgtaagac

SEQ ID NO: 136 - DNA, 25 bp, equine
aaatatgctggatgtttttcaaaat

SEQ ID NO: 137 - DNA, 25 bp, equine
gcactatactataaactatgctgag

SEQ ID NO: 138 - DNA, 25 bp, equine
aactatgctgaggtgctacattctt

SEQ ID NO: 139 - DNA, 25 bp, equine
gctgaggtgctacattcttagtaaa

SEQ ID NO: 140 - DNA, 25 bp, equine
gtaaatgtgccaagacctagtcctg

SEQ ID NO: 141 - DNA, 25 bp, equine
aagacctagtcctgctactgacact

SEQ ID NO: 142 - DNA, 25 bp, equine
tgctactgacactttcctcgccttg

SEQ ID NO: 143 - DNA, 25 bp, equine
ctcgccttgcctatactctaaaggt

SEQ ID NO: 144 - DNA, 25 bp, equine
taaaggttctcaacggatctttcca

SEQ ID NO: 145 - DNA, 25 bp, equine
gatctttccacctctgggcttatca

SEQ ID NO: 146 - DNA, 25 bp, equine
gggcttatcagagttctcagatctc

SEQ ID NO: 147 - DNA, 25 bp, equine
gcaataatacaatctgcttttttaa

SEQ ID NO: 148 - DNA, 25 bp, equine
gtgggcagagacttggcatcattgt

SEQ ID NO: 149 - DNA, 25 bp, equine
ggcatcattgtcatccagcaaataa

SEQ ID NO: 150 - DNA, 25 bp, equine
tcagtctcccctagtccagaaaagg

SEQ ID NO: 151 - DNA, 25 bp, equine
cagaaaagggcctcacctgccaggg

SEQ ID NO: 152 - DNA, 25 bp, equine
tgcgcattgctttccaaggagcctt

SEQ ID NO: 153 - DNA, 25 bp, equine
aaggagccttcttgaggtcactgca

SEQ ID NO: 154 - DNA, 25 bp, equine
gaggtcactgcatttgatcttcatg

SEQ ID NO: 155 - DNA, 25 bp, equine
tttgatcttcatggcggcacctgga

SEQ ID NO: 156 - DNA, 25 bp, equine
gacatgagcgtttgtgtttgcttta

SEQ ID NO: 157 - DNA, 25 bp, equine
atccagggtggagtctatgcagaaa

SEQ ID NO: 158 - DNA, 25 bp, equine
gaaatgacccataatccagcaacgc

SEQ ID NO: 159 - DNA, 25 bp, equine
gggctagaagatcatccttggttga

SEQ ID NO: 160 - DNA, 25 bp, equine
aattcaacatgctcactatcagtag

SEQ ID NO: 161 - DNA, 25 bp, equine
tgaactgagctttgtctctgcagca

SEQ ID NO: 162 - DNA, 25 bp, equine
aatggcagtcatccattggctgcac

SEQ ID NO: 163 - DNA, 25 bp, equine
tcctcacccttctttatgtgcttag

SEQ ID NO: 164 - DNA, 25 bp, equine
atgtgcttagatacgtgctccagac

SEQ ID NO: 165 - DNA, 25 bp, equine
aagtcccattcatgagcttcctgtt

SEQ ID NO: 166 - DNA, 25 bp, equine
gcttcctgttagatgtgaacctcca

SEQ ID NO: 167 - DNA, 25 bp, equine
gtgaacctccagcagaggcaacgct

SEQ ID NO: 168 - DNA, 25 bp, equine
tgccccttggctggattcattcaaa

SEQ ID NO: 169 - DNA, 25 bp, equine
gcaatggtcctcaattctgtttatt

SEQ ID NO: 170 - DNA, 25 bp, equine
actgacagttgaaacgatcaatgga

SEQ ID NO: 171 - DNA, 25 bp, equine
tcaatggaatgatcagcacaaacag

SEQ ID NO: 172 - DNA, 25 bp, equine
tgtgatatcctctatatctaagata

SEQ ID NO: 173 - DNA, 25 bp, equine
ataacatgtactctctctatatata

SEQ ID NO: 174 - DNA, 25 bp, equine
gctgttactggaaagatgaccgcaa

SEQ ID NO: 175 - DNA, 25 bp, equine
gatgaccgcaagaagttgatttttt

SEQ ID NO: 176 - DNA, 25 bp, equine
gaagttgattttttatctaccagaa

SEQ ID NO: 177 - DNA, 25 bp, equine
atctaccagaagttttcttcgctgt

SEQ ID NO: 178 - DNA, 25 bp, equine
tttcttcgctgtgttttaagtcggc

SEQ ID NO: 179 - DNA, 25 bp, equine
tttaagtcggcgatctgctttgatc

SEQ ID NO: 180 - DNA, 25 bp, equine
tgctttgatcgttttgttcgcttct

SEQ ID NO: 181 - DNA, 25 bp, equine
gtctagtcttgaagtccctcattta

SEQ ID NO: 182 - DNA, 25 bp, equine
taatgtgatgtttcggccaagccca

SEQ ID NO: 183 - DNA, 25 bp, equine
gagttccctgccctgagagaatgtc

SEQ ID NO: 184 - DNA, 25 bp, equine
gagagaatgtcaccacctgagcagc

SEQ ID NO: 185 - DNA, 25 bp, equine
aagagtgatgccctggtgtctccag

SEQ ID NO: 186 - DNA, 25 bp, equine
ggtgataggacatctggcttgccag

SEQ ID NO: 187 - DNA, 25 bp, equine
ggcttgccagcgaggtctttttgac

SEQ ID NO: 188 - DNA, 25 bp, equine
aggccacccttctagcagagttaaa

SEQ ID NO: 189 - DNA, 25 bp, equine
tatgtgtcagtcacgtagccagctg

SEQ ID NO: 190 - DNA, 25 bp, equine
agaacttgcggcttgactagcagca

SEQ ID NO: 191 - DNA, 25 bp, equine
cagctgcccaatgccatgtgaagta

SEQ ID NO: 192 - DNA, 25 bp, equine
agctcgtgccgttctgtgagacttg

SEQ ID NO: 193 - DNA, 25 bp, equine
gagacttgtctttcccacgaaatag

SEQ ID NO: 194 - DNA, 25 bp, equine
agacaactcttccacggcacagatg

SEQ ID NO: 195 - DNA, 25 bp, equine
agacacagtgccgtacatcaatcag

SEQ ID NO: 196 - DNA, 25 bp, equine
tcagcacggctttaatcgcagttat

SEQ ID NO: 197 - DNA, 25 bp, equine
gaacgtatttcgctgttgatgccag

SEQ ID NO: 198 - DNA, 25 bp, equine
gatgccagttattctgctaacgatg

SEQ ID NO: 199 - DNA, 25 bp, equine
gtgcgagtacttacaggagtctaca

SEQ ID NO: 200 - DNA, 25 bp, equine
gagtctacacagttggacacgcagc

SEQ ID NO: 201 - DNA, 25 bp, equine
tacggatctgtttgactctgtcaca

SEQ ID NO: 202 - DNA, 25 bp, equine
gatacacggcatccaaagctatttg

SEQ ID NO: 203 - DNA, 25 bp, equine
ggaccgcgtctggaggatgcctctc

SEQ ID NO: 204 - DNA, 25 bp, equine
tgcctctctttgaccattatactag

SEQ ID NO: 205 - DNA, 25 bp, equine
ttgtcgattgccaacttgctgatgt

SEQ ID NO: 206 - DNA, 25 bp, equine
gagcatgtacagctgcagcattcct

SEQ ID NO: 207 - DNA, 25 bp, equine
tgtgactcatcctaagtgggcgcat

SEQ ID NO: 208 - DNA, 25 bp, equine
tgggcgcatttagacatagcaggag

SEQ ID NO: 209 - DNA, 25 bp, equine
gagattccgtatctgcgtaaaggca

SEQ ID NO: 210 - DNA, 25 bp, equine
acgaggaccctgatagagttcttgc

SEQ ID NO: 211 - DNA, 25 bp, equine
agagttcttgcttcggttcagtcaa

SEQ ID NO: 212 - DNA, 25 bp, equine
aaatgccttcattctgtcttaagtg

SEQ ID NO: 213 - DNA, 25 bp, equine
aaaactaatggcttgcttggcaaag

SEQ ID NO: 214 - DNA, 25 bp, equine
tactgtcacctatcaagcgtcttaa

SEQ ID NO: 215 - DNA, 25 bp, equine
acgggcatctgcttttgagtgactt

SEQ ID NO: 216 - DNA, 25 bp, equine
gttgcattctcatctgctaaattgg

SEQ ID NO: 217 - DNA, 25 bp, equine
gctgaaagagatgagtgcccaccct

SEQ ID NO: 218 - DNA, 25 bp, equine
tggactcgcttcagcagtgacgggc

SEQ ID NO: 219 - DNA, 25 bp, equine
ttggaggtcgcgtgcttcagtctcg

SEQ ID NO: 220 - DNA, 25 bp, equine
gtctcgcgctgatagatggtgtcca

SEQ ID NO: 221 - DNA, 25 bp, equine
tcccgccagctgagagtgagccaaa

SEQ ID NO: 222 - DNA, 25 bp, equine
aaactcccagctttcggtccagaag

SEQ ID NO: 223 - DNA, 25 bp, equine
gaattcagatcactcactcgggaaa

SEQ ID NO: 224 - DNA, 25 bp, equine
gtgtcaagcaagtcctcaaacggca

SEQ ID NO: 225 - DNA, 25 bp, equine
ctacccagggactttctgacagtat

SEQ ID NO: 226 - DNA, 25 bp, equine
tgagtttctaagtcagcttccagct

SEQ ID NO: 227 - DNA, 25 bp, equine
ttccagctgtgtttcatctccttca

SEQ ID NO: 228 - DNA, 25 bp, equine
atctccttcacctgcattttatttg

SEQ ID NO: 229 - DNA, 25 bp, equine
aagcatggtttgttcactccttcaa

SEQ ID NO: 230 - DNA, 25 bp, equine
tttcctccactaagcagatgatcct

SEQ ID NO: 231 - DNA, 25 bp, equine
tggattcccgctggagcagtgctac

SEQ ID NO: 232 - DNA, 25 bp, equine
cctctgttccggtgattggtttgtt

SEQ ID NO: 233 - DNA, 25 bp, equine
gattggtttgttcctttcttgtatc

SEQ ID NO: 234 - DNA, 25 bp, equine
acaactacacgatcccagagacata

SEQ ID NO: 235 - DNA, 25 bp, equine
gttaattccagctgacgagagacca

SEQ ID NO: 236 - DNA, 25 bp, equine
agcatcaaggcctatgtcagcactt

SEQ ID NO: 237 - DNA, 25 bp, equine
gtgatgttcacacctctgacagtga

SEQ ID NO: 238 - DNA, 25 bp, equine
aacgcatcggagttgacctgatcat

SEQ ID NO: 239 - DNA, 25 bp, equine
tcatgaagacctgttttagccccaa

SEQ ID NO: 240 - DNA, 25 bp, equine
gggtgatcggactctcaagtgactt

SEQ ID NO: 241 - DNA, 25 bp, equine
ctgacaatacagtgggccgcttctt

SEQ ID NO: 242 - DNA, 25 bp, equine
gccgcttcttgatgagtctggttaa

SEQ ID NO: 243 - DNA, 25 bp, equine
gttcctgatgacttcgagaccatgc

SEQ ID NO: 244 - DNA, 25 bp, equine
tgatggtgacctacttggccaatct

SEQ ID NO: 245 - DNA, 25 bp, equine
tggccaatctcacacaatcacaaat

SEQ ID NO: 246 - DNA, 25 bp, equine
gtaaacctgtgaatgggccccaatc

SEQ ID NO: 247 - DNA, 25 bp, equine
tacttttcacatgggcccctctatg

SEQ ID NO: 248 - DNA, 25 bp, equine
cctctatgtgacctgcttagggtaa

SEQ ID NO: 249 - DNA, 25 bp, equine
gacctgcttagggtaagtatcacca

SEQ ID NO: 250 - DNA, 25 bp, equine
gtatcaccagggatttatgtattta

SEQ ID NO: 251 - DNA, 25 bp, equine
aatagttttcttgagcagctgctgg

SEQ ID NO: 252 - DNA, 25 bp, equine
tcttgagcagctgctgggatctgct

SEQ ID NO: 253 - DNA, 25 bp, equine
gaagctttgctaataatccatttat

SEQ ID NO: 254 - DNA, 25 bp, equine
aatccatttatatgggctgaattat

SEQ ID NO: 255 - DNA, 25 bp, equine
gctataaattgatcaaggccacttt

SEQ ID NO: 256 - DNA, 25 bp, equine
aaggccactttattatggaatccca

SEQ ID NO: 257 - DNA, 25 bp, equine
attatggaatcccatctgctaccct

SEQ ID NO: 258 - DNA, 25 bp, equine
aaacttatgtcctcagttccatctg

SEQ ID NO: 259 - DNA, 25 bp, equine
aacccaatggcaccttcagcagtaa

SEQ ID NO: 260 - DNA, 25 bp, equine
gaattttaccccatcatatacctga

SEQ ID NO: 261 - DNA, 25 bp, equine
atatgttttcctgcagccttataag

SEQ ID NO: 262 - DNA, 25 bp, equine
gttttcatgctaaacctggccattt

SEQ ID NO: 263 - DNA, 25 bp, equine
ggccatttcagatctcttgttcaca

SEQ ID NO: 264 - DNA, 25 bp, equine
gtcttattccctatatgtcaacatg

SEQ ID NO: 265 - DNA, 25 bp, equine
catctatttcctgactgtgctgagt

SEQ ID NO: 266 - DNA, 25 bp, equine
ttgtgcgtttcctggcaactgttca

SEQ ID NO: 267 - DNA, 25 bp, equine
aagtgcctggattctatgtgggatc

SEQ ID NO: 268 - DNA, 25 bp, equine
ggatctttattatggcttcgtcagc

SEQ ID NO: 269 - DNA, 25 bp, equine
ttcaaatttagctggaaatcctgta

SEQ ID NO: 270 - DNA, 25 bp, equine
aaatcctgtattttgctgttgttgc

SEQ ID NO: 271 - DNA, 25 bp, equine
ttttgctgttgttgctaaatcttgc

SEQ ID NO: 272 - DNA, 25 bp, equine
taaatcttgcaaccctagtctgctg

SEQ ID NO: 273 - DNA, 25 bp, equine
tagtctgctgcccaggatccatgag

SEQ ID NO: 274 - DNA, 25 bp, equine
atccatgagtccctgttcaactaag

SEQ ID NO: 275 - DNA, 25 bp, equine
gttcaactaagccttggtttcttct

SEQ ID NO: 276 - DNA, 25 bp, equine
tggtttcttctttaatcctaaactg

SEQ ID NO: 277 - DNA, 25 bp, equine
ggagaaaagcatcagccactatcct

SEQ ID NO: 278 - DNA, 25 bp, equine
actatcctccctcacagagagctga

SEQ ID NO: 279 - DNA, 25 bp, equine
ggactggtggaagcacattaactta

SEQ ID NO: 280 - DNA, 25 bp, equine
tgttcttatcagtcatgggccatcc

SEQ ID NO: 281 - DNA, 25 bp, equine
tgggccatccgcagggtagcaagat

SEQ ID NO: 282 - DNA, 25 bp, equine
agtcattctacttttagcacgtgtc

SEQ ID NO: 283 - DNA, 25 bp, equine
agcacgtgtccatgggctacaattg

SEQ ID NO: 284 - DNA, 25 bp, equine
attggttggcttgaccaaggtctgc

SEQ ID NO: 285 - DNA, 25 bp, equine
caaggtctgcatgtggaatgtccgt

SEQ ID NO: 286 - DNA, 25 bp, equine
ggaatgtccgtgatctcttaactac

SEQ ID NO: 287 - DNA, 25 bp, equine
tagacagggccaagactagcacaag

SEQ ID NO: 288 - DNA, 25 bp, equine
ggatgccctcattttgaagtcgtgc

SEQ ID NO: 289 - DNA, 25 bp, equine
gagtgtcttcttaaattctttgcct

SEQ ID NO: 290 - DNA, 25 bp, equine
taaattctttgcctcactctagtgc

SEQ ID NO: 291 - DNA, 25 bp, equine
cgagccttctttgggtcccagaata

SEQ ID NO: 292 - DNA, 25 bp, equine
aataacttctgtgccttcaatctga

SEQ ID NO: 293 - DNA, 25 bp, equine
aacactacctcagctggtcaatgct

SEQ ID NO: 294 - DNA, 25 bp, equine
gtcaatgctcctgggtgtgggcacc

SEQ ID NO: 295 - DNA, 25 bp, equine
actagtcctaggcatcatggcggtg

SEQ ID NO: 296 - DNA, 25 bp, equine
atgctgctggcaggaggcctgttta

SEQ ID NO: 297 - DNA, 25 bp, equine
gcctgtttatgctgctgggccacaa

SEQ ID NO: 298 - DNA, 25 bp, equine
gggccacaagcggtactcagaatac

SEQ ID NO: 299 - DNA, 25 bp, equine
aattgagacccactctctagaggga

SEQ ID NO: 300 - DNA, 25 bp, equine
gaaggacattactggacctgccttg

SEQ ID NO: 301 - DNA, 25 bp, equine
gctcccttcttgcttttatgcagaa

SEQ ID NO: 302 - DNA, 25 bp, equine
ccgttcgcgtgcacccagggaggac

SEQ ID NO: 303 - DNA, 25 bp, equine
tgcacccagggaggactcggagtcc

SEQ ID NO: 304 - DNA, 25 bp, equine
cattttcttctggtcgccgtggtca

SEQ ID NO: 305 - DNA, 25 bp, equine
gtcgccgtggtcacccacaggaagg

SEQ ID NO: 306 - DNA, 25 bp, equine
cagcctgggttttctcgggcggctc

SEQ ID NO: 307 - DNA, 25 bp, equine
caggtctcagcctgtgaggactgcg

SEQ ID NO: 308 - DNA, 25 bp, equine
gactgcggcgagtctggagacccca

SEQ ID NO: 309 - DNA, 25 bp, equine
tcttcgggactgtgtggacccacga

SEQ ID NO: 310 - DNA, 25 bp, equine
gtgtggacccacgagggccatctgc

SEQ ID NO: 311 - DNA, 25 bp, equine
gagggccatctgctgacagagcaac

SEQ ID NO: 312 - DNA, 25 bp, equine
gtgggctctgtctggttcacagagc

SEQ ID NO: 313 - DNA, 25 bp, equine
aggaggtgcctcacgactgtcctgg

SEQ ID NO: 314 - DNA, 25 bp, equine
gagggacctcatgccaagggtgccc

SEQ ID NO: 315 - DNA, 25 bp, equine
gcctgacccggccatagaggaaatc

SEQ ID NO: 316 - DNA, 25 bp, equine
caagatcttggtgttgtctgggaaa

SEQ ID NO: 317 - DNA, 25 bp, equine
tgggaaaagcacgttcagcgcccac

SEQ ID NO: 318 - DNA, 25 bp, equine
atgaaaacacgcagctcgttggctc

SEQ ID NO: 319 - DNA, 25 bp, equine
ttggctcctgagaccccggaggaca

SEQ ID NO: 320 - DNA, 25 bp, equine
cagcgaggaggcacagcacacggtc

SEQ ID NO: 321 - DNA, 25 bp, equine
agcctgacccgctgggcgacagagt

SEQ ID NO: 322 - DNA, 25 bp, equine
gtcacagttccagagacacttgagt

SEQ ID NO: 323 - DNA, 25 bp, equine
agatttgtacacttctctcgtagaa

SEQ ID NO: 324 - DNA, 25 bp, equine
agcctcaatctgctgttagtcctaa

SEQ ID NO: 325 - DNA, 25 bp, equine
aatgggctagcaaaggccatcttct

SEQ ID NO: 326 - DNA, 25 bp, equine
gccatcttctcactacttggataga

SEQ ID NO: 327 - DNA, 25 bp, equine
aaactcctgtaccttgtttgcagtg

SEQ ID NO: 328 - DNA, 25 bp, equine
gtggcaaatacatttcccagcaggc

SEQ ID NO: 329 - DNA, 25 bp, equine
ttcccagcaggcctttattgattgt

SEQ ID NO: 330 - DNA, 25 bp, equine
ttgtactaacctcaaagctgctgga

SEQ ID NO: 331 - DNA, 25 bp, equine
gtccatttggttgatgagctctgcc

SEQ ID NO: 332 - DNA, 25 bp, equine
gagctctgccattttggaacctaat

SEQ ID NO: 333 - DNA, 25 bp, equine
ggaacctaatctctactctttagct

SEQ ID NO: 334 - DNA, 25 bp, equine
agctacatatgccatctacaggtcc

SEQ ID NO: 335 - DNA, 25 bp, equine
cacgggaaggtggaagtttcagaca

SEQ ID NO: 336 - DNA, 25 bp, equine
tgagggcattcaaattgtctttttt

SEQ ID NO: 337 - DNA, 25 bp, equine
ttttttccatcctcgtctgtcagtt

SEQ ID NO: 338 - DNA, 25 bp, equine
ctcgtctgtcagtttccctgaaaaa

SEQ ID NO: 339 - DNA, 25 bp, equine
aaattcatattccagtgcctatccg

SEQ ID NO: 340 - DNA, 25 bp, equine
agtgcctatccgtgggatccttcac

SEQ ID NO: 341 - DNA, 25 bp, equine
gatccttcacgttctttgacattga

SEQ ID NO: 342 - DNA, 25 bp, equine
aaaaagagaactcacctcgctcttc

SEQ ID NO: 343 - DNA, 25 bp, equine
tgtgcccctctgatactggcagatg

SEQ ID NO: 344 - DNA, 25 bp, equine
gatactggcagatgcctcttcctct

SEQ ID NO: 345 - DNA, 25 bp, equine
acgcacgcaccccagtggtgggttc

SEQ ID NO: 346 - DNA, 25 bp, equine
gagaaactcctaagttcctgtggaa

SEQ ID NO: 347 - DNA, 25 bp, equine
aacctatggtggctgtgaaggccct

SEQ ID NO: 348 - DNA, 25 bp, equine
aggccctgatgccatgtatgtcaaa

SEQ ID NO: 349 - DNA, 25 bp, equine
aattgatatcctctgatggccatga

SEQ ID NO: 350 - DNA, 25 bp, equine
gagaacacgcactaacatcaggaac

SEQ ID NO: 351 - DNA, 25 bp, equine
tgagtggcccaggtcagtttgctga

SEQ ID NO: 352 - DNA, 25 bp, equine
tagagagatcccttcacatgtgttg

SEQ ID NO: 353 - DNA, 25 bp, equine
aaggttcgctacactaacagctcca

SEQ ID NO: 354 - DNA, 25 bp, equine
agctccacggagattcctgaattcc

SEQ ID NO: 355 - DNA, 25 bp, equine
cctgaattcccaattgcacctgaaa

SEQ ID NO: 356 - DNA, 25 bp, equine
actggaactgctgatggctgcgaac

SEQ ID NO: 357 - DNA, 25 bp, equine
agacctgcatattcggtgaccttaa

SEQ ID NO: 358 - DNA, 25 bp, equine
gtagagaacactgattcccaatccc

SEQ ID NO: 359 - DNA, 25 bp, equine
tcccacccagagattagttttcgtt

SEQ ID NO: 360 - DNA, 25 bp, equine
gttttcgttgcaacatggaacagtt

SEQ ID NO: 361 - DNA, 25 bp, equine
ggaagttaacgatctgcccgggtct

SEQ ID NO: 362 - DNA, 25 bp, equine
cgatctgcccgggtctagaggaaga

SEQ ID NO: 363 - DNA, 25 bp, equine
aggaagaccaggaacgccttgccat

SEQ ID NO: 364 - DNA, 25 bp, equine
ttgccatcggcagaagcgtcgttga

SEQ ID NO: 365 - DNA, 25 bp, equine
tcgttgatgcgagctggatgtcctc

SEQ ID NO: 366 - DNA, 25 bp, equine
ggatgtcctccttttcagtagaaac

SEQ ID NO: 367 - DNA, 25 bp, equine
gtgaactgcacattgatcccatttt

SEQ ID NO: 368 - DNA, 25 bp, equine
aaagctgtgcctccgagcaagcaaa

SEQ ID NO: 369 - DNA, 25 bp, equine
agcaaaaagagttcgcccatggatc

SEQ ID NO: 370 - DNA, 25 bp, equine
gagttcgcccatggatcgaaacagt

SEQ ID NO: 371 - DNA, 25 bp, equine
ggatcgaaacagtgacgagttccgt

SEQ ID NO: 372 - DNA, 25 bp, equine
gacgagttccgtcaacgcagagaga

SEQ ID NO: 373 - DNA, 25 bp, equine
gagagaggaacatcatggccgtgaa

SEQ ID NO: 374 - DNA, 25 bp, equine
tcatggccgtgaaaaagagccggtt

SEQ ID NO: 375 - DNA, 25 bp, equine
aagagccggttgaaaagcaagcaga

SEQ ID NO: 376 - DNA, 25 bp, equine
agcaagcagaaagcgcaggatacac

SEQ ID NO: 377 - DNA, 25 bp, equine
tacactgcagagagtgaatcagctt

SEQ ID NO: 378 - DNA, 25 bp, equine
gaagagaatgatcgcttggaagcaa

SEQ ID NO: 379 - DNA, 25 bp, equine
gaatgagtagctttctgatgctctg

SEQ ID NO: 380 - DNA, 25 bp, equine
tgatgctctgtatgtcaaacccacc

SEQ ID NO: 381 - DNA, 25 bp, equine
acccctggcccaagaaattgcagtc

SEQ ID NO: 382 - DNA, 25 bp, equine
aaactgccctttgtcctcaaagaag

SEQ ID NO: 383 - DNA, 25 bp, equine
tatctgccttgttcttatcaacttg

SEQ ID NO: 384 - DNA, 25 bp, equine
tctaaccgtgttttgttggctacag

SEQ ID NO: 385 - DNA, 25 bp, equine
aagtgccctaattgaatgtgtttga

SEQ ID NO: 386 - DNA, 25 bp, equine
gtgtttgaatgttatccttgcacaa

SEQ ID NO: 387 - DNA, 25 bp, equine
aaatgttttacctcactgttggaca

SEQ ID NO: 388 - DNA, 25 bp, equine
acattccaagcttttcaactctagg

SEQ ID NO: 389 - DNA, 25 bp, equine
agtcatatgttttcctgtattgtaa

SEQ ID NO: 390 - DNA, 25 bp, equine
gattttgcctttggtttgggtctca

SEQ ID NO: 391 - DNA, 25 bp, equine
ttaatcttttttctggcttcttctg

SEQ ID NO: 392 - DNA, 25 bp, equine
tggcttcttctgcatgttctaggaa

SEQ ID NO: 393 - DNA, 25 bp, equine
agagttgtatgtattcttcccggaa

SEQ ID NO: 394 - DNA, 25 bp, equine
ttcccggaatttggcagacttctcg

SEQ ID NO: 395 - DNA, 25 bp, equine
aaacagcttactggcgctttccaat

SEQ ID NO: 396 - DNA, 25 bp, equine
ctcccctgtggatgtgttgattgca

SEQ ID NO: 397 - DNA, 25 bp, equine
gattttatctccaacttgtgcctgt

SEQ ID NO: 398 - DNA, 25 bp, equine
ggataagtggcctgctggacctgct

SEQ ID NO: 399 - DNA, 25 bp, equine
gctgcatgatttcaccactggtcaa

SEQ ID NO: 400 - DNA, 25 bp, equine
taaactgaagcaccttggccatctg

SEQ ID NO: 401 - DNA, 25 bp, equine
gctggatccctcacagggctgggaa

SEQ ID NO: 402 - DNA, 25 bp, equine
ggcaatgggagtacactttgatgac

SEQ ID NO: 403 - DNA, 25 bp, equine
gtgattatttccgtagtgaccctgc

SEQ ID NO: 404 - DNA, 25 bp, equine
agtgaccctgcctgggaggctcaga

SEQ ID NO: 405 - DNA, 25 bp, equine
gcaggcagggatcagacgtcattat

SEQ ID NO: 406 - DNA, 25 bp, equine
atgaacacagtgatgggcggcagtc

SEQ ID NO: 407 - DNA, 25 bp, equine
tcgccccatgagtgtccctttgagg

SEQ ID NO: 408 - DNA, 25 bp, equine
aagagggatgctgcatttctcagct

SEQ ID NO: 409 - DNA, 25 bp, equine
gcatttctcagctgggcagtaatca

SEQ ID NO: 410 - DNA, 25 bp, equine
gcagtaatcaacttaatggtccttt

SEQ ID NO: 411 - DNA, 25 bp, equine
atggtccttttaaaatgtctgtgta

SEQ ID NO: 412 - DNA, 25 bp, equine
gttatcatggccacaaaccgaatag

SEQ ID NO: 413 - DNA, 25 bp, equine
ttggacccagcacttatcagaccag

SEQ ID NO: 414 - DNA, 25 bp, equine
agaccaggccgcattgacaggaaga

SEQ ID NO: 415 - DNA, 25 bp, equine
cccctgcctgatgagaagaccaaga

SEQ ID NO: 416 - DNA, 25 bp, equine
agaagcgcatctttcagatccacac

SEQ ID NO: 417 - DNA, 25 bp, equine
agatccacaccagcaggatgacgct

SEQ ID NO: 418 - DNA, 25 bp, equine
gatgacgctggctgacgacgttacc

SEQ ID NO: 419 - DNA, 25 bp, equine
gttaccctggacgacttgatcatgg

SEQ ID NO: 420 - DNA, 25 bp, equine
atggctaaagacgacctgtccggtg

SEQ ID NO: 421 - DNA, 25 bp, equine
tgtccggtgccgacatcaaggcaat

SEQ ID NO: 422 - DNA, 25 bp, equine
agaagctggtctgatggccttgaga

SEQ ID NO: 423 - DNA, 25 bp, equine
ctttgagttgatgcgggagccatgc

SEQ ID NO: 424 - DNA, 25 bp, equine
cggcatcacttatgaccgcaaagac

SEQ ID NO: 425 - DNA, 25 bp, equine
accgcaaagacatcgaggagcacct

SEQ ID NO: 426 - DNA, 25 bp, equine
aggagcacctgcagcgtgtaggcca

SEQ ID NO: 427 - DNA, 25 bp, equine
gtgtaggccactttgaccctgtgac

SEQ ID NO: 428 - DNA, 25 bp, equine
catccctaacctggccatgaaagag

SEQ ID NO: 429 - DNA, 25 bp, equine
aagaggtcatcgacgcattcatctc

SEQ ID NO: 430 - DNA, 25 bp, equine
attcatctccgagaacggctgggtg

SEQ ID NO: 431 - DNA, 25 bp, equine
tgcctggtaacctggccctagaggg

SEQ ID NO: 432 - DNA, 25 bp, equine
gtacagagtttgtgtccctggatcc

SEQ ID NO: 433 - DNA, 25 bp, equine
atcagttctgctgctgggccgtgag

SEQ ID NO: 434 - DNA, 25 bp, equine
aatgggctccgtcatgatcttatgt

SEQ ID NO: 435 - DNA, 25 bp, equine
ttccttcaaatctgaggcttgcctg

SEQ ID NO: 436 - DNA, 25 bp, equine
gcagagcgcctgtgatttggctcaa

SEQ ID NO: 437 - DNA, 25 bp, equine
gatttggctcaagactcctgtatga

SEQ ID NO: 438 - DNA, 25 bp, equine
gaaaatgctgctcttctaagtcctt

SEQ ID NO: 439 - DNA, 25 bp, equine
ctaagtcctttgtggcttgtaagtg

SEQ ID NO: 440 - DNA, 25 bp, equine
gaatttcatccaaatgttaccctgt

SEQ ID NO: 441 - DNA, 25 bp, equine
tgttaccctgtaatactggcattta

SEQ ID NO: 442 - DNA, 25 bp, equine
tcttcctcaccctttttacagtgga

SEQ ID NO: 443 - DNA, 25 bp, equine
taataattggaacatcctgcccctt

SEQ ID NO: 444 - DNA, 25 bp, equine
caatcctagttgtctaccttctttt

SEQ ID NO: 445 - DNA, 25 bp, equine
gatagactgagtccacgtctcctta

SEQ ID NO: 446 - DNA, 25 bp, equine
aggtctatatataaggtggccccac

SEQ ID NO: 447 - DNA, 25 bp, equine
acattgcctgctaacttgacttctt

SEQ ID NO: 448 - DNA, 25 bp, equine
gctcggcttatgtcagtattctctg

SEQ ID NO: 449 - DNA, 25 bp, equine
tttgccttcatgtgccaagcttgaa

SEQ ID NO: 450 - DNA, 25 bp, equine
gatttgatttcctgagtgacctgtc

SEQ ID NO: 451 - DNA, 25 bp, equine
tgacctgtctgctttcgatgtgcca

SEQ ID NO: 452 - DNA, 25 bp, equine
tagttcatctttcatctcattcgtg

SEQ ID NO: 453 - DNA, 25 bp, equine
gggtcaagtcttttcaggtgtttat

SEQ ID NO: 454 - DNA, 25 bp, equine
aaatgattttgtgttcccttcccat

SEQ ID NO: 455 - DNA, 25 bp, equine
aagcccagtgtattgtacttcaccc

SEQ ID NO: 456 - DNA, 25 bp, equine
tgtgcagtcccacatgctcatggtg

SEQ ID NO: 457 - DNA, 25 bp, equine
tccaggaggcctgtcatgtccagca

SEQ ID NO: 458 - DNA, 25 bp, equine
agtgggcacactcctgaagcagctg

SEQ ID NO: 459 - DNA, 25 bp, equine
ggaagggccacgtgtgcaccagctc

SEQ ID NO: 460 - DNA, 25 bp, equine
acgacggtcttcttgtccatgaagg

SEQ ID NO: 461 - DNA, 25 bp, equine
tgaaggccaccttgaacagcagagg

SEQ ID NO: 462 - DNA, 25 bp, equine
tgccgcgtgctcaggaacacaagcg

SEQ ID NO: 463 - DNA, 25 bp, equine
aggaagccacctcgctgtaacagga

SEQ ID NO: 464 - DNA, 25 bp, equine
gtaacaggacagaccaaccgagcac

SEQ ID NO: 465 - DNA, 25 bp, equine
aaccgagcacctgtcacgagaggaa

SEQ ID NO: 466 - DNA, 25 bp, equine
aaagcagccagtggtcaccgtggga

SEQ ID NO: 467 - DNA, 25 bp, equine
attctccaagaaatagcctactcaa

SEQ ID NO: 468 - DNA, 25 bp, equine
tagctgagaacttcccaaacctggg

SEQ ID NO: 469 - DNA, 25 bp, equine
gaagacaacagacctccgaactata

SEQ ID NO: 470 - DNA, 25 bp, equine
aaagaccttctccaaggcatatatt

SEQ ID NO: 471 - DNA, 25 bp, equine
taagggcagcaaggcagaggacaat

SEQ ID NO: 472 - DNA, 25 bp, equine
aaagggactcctatcaggctttcag

SEQ ID NO: 473 - DNA, 25 bp, equine
ctttcagtggatttctcagcagata

SEQ ID NO: 474 - DNA, 25 bp, equine
tcagcagataccttacaggctagga

SEQ ID NO: 475 - DNA, 25 bp, equine
gaggacaaaaactttcagccaagaa

SEQ ID NO: 476 - DNA, 25 bp, equine
agccaagaatactctatccagtgaa

SEQ ID NO: 477 - DNA, 25 bp, equine
gctaagggagtttatcaccacaaga

SEQ ID NO: 478 - DNA, 25 bp, equine
catttccaccccaacatagagtagt

SEQ ID NO: 479 - DNA, 25 bp, equine
gagtagtatttgctttttagtccat

SEQ ID NO: 480 - DNA, 25 bp, equine
tgctttttagtccattttgttttca

SEQ ID NO: 481 - DNA, 25 bp, equine
atatcgatcagagtcattcttttgt

SEQ ID NO: 482 - DNA, 25 bp, equine
cagagtcattcttttgttcattgaa

SEQ ID NO: 483 - DNA, 25 bp, equine
catacccctaaaccaaccaggattg

SEQ ID NO: 484 - DNA, 25 bp, equine
aggattggaaggtaccaccgctggt

SEQ ID NO: 485 - DNA, 25 bp, equine
aaggtaccaccgctggtgctgcctt

SEQ ID NO: 486 - DNA, 25 bp, equine
tcccacagcctgtaacttaatgttt

SEQ ID NO: 487 - DNA, 25 bp, equine
gtaacttaatgttttgtacttcaat

SEQ ID NO: 488 - DNA, 25 bp, equine
gtgatggttagaaacttcgtgtata

SEQ ID NO: 489 - DNA, 25 bp, equine
gtgactatttcacttgacccttttt

SEQ ID NO: 490 - DNA, 25 bp, equine
taccaagaccctgtgagctgtgtgt

SEQ ID NO: 491 - DNA, 25 bp, equine
gctgtgtgtttatttccctcaatga

SEQ ID NO: 492 - DNA, 25 bp, equine
ccagtcactgcctgttggagaacat

SEQ ID NO: 493 - DNA, 25 bp, equine
gaacatgtctgcattgtgagccact

SEQ ID NO: 494 - DNA, 25 bp, equine
atggcatgtcaaaccacgcttgaat

SEQ ID NO: 495 - DNA, 25 bp, equine
gtgtcaggtgatagggcttgtcccc

SEQ ID NO: 496 - DNA, 25 bp, equine
gggcttgtcccctgataaagcttag

SEQ ID NO: 497 - DNA, 25 bp, equine
taaagcttagtatctcctctcatgc

SEQ ID NO: 498 - DNA, 25 bp, equine
ctctcatgcctagtgcttcagaata

SEQ ID NO: 499 - DNA, 25 bp, equine
gttgacaactgtgactgcacccaaa

SEQ ID NO: 500 - DNA, 25 bp, equine
tacgtcaggtttcagctacattcgc

SEQ ID NO: 501 - DNA, 25 bp, equine
tgataagctgcttcgatcgcaaaga

SEQ ID NO: 502 - DNA, 25 bp, equine
tcaggctcctgaacccacagaaagg

SEQ ID NO: 503 - DNA, 25 bp, equine
aagggcatcttcagacgtagtcacc

SEQ ID NO: 504 - DNA, 25 bp, equine
gacaaaaacctcatccatgccaatg

SEQ ID NO: 505 - DNA, 25 bp, equine
aacatgtgggttctgcaattgggac

SEQ ID NO: 506 - DNA, 25 bp, equine
acatcagttacagtggcagtgccgt

SEQ ID NO: 507 - DNA, 25 bp, equine
agtcctcctctgtgtgttatgtaag

SEQ ID NO: 508 - DNA, 25 bp, equine
ctctccagatttgcaggctcattat

SEQ ID NO: 509 - DNA, 25 bp, equine
tcattatgaacgtgtggccccagac

SEQ ID NO: 510 - DNA, 25 bp, equine
ggccccagactgatgcttgagctaa

SEQ ID NO: 511 - DNA, 25 bp, equine
agcggcacgagttagctcaggacaa

SEQ ID NO: 512 - DNA, 25 bp, equine
gaattagcttgctgctttattcaga

SEQ ID NO: 513 - DNA, 25 bp, equine
gcaggccctgagatggacaagagat

SEQ ID NO: 514 - DNA, 25 bp, equine
ggtactgtgatcctgttgtgttaac

SEQ ID NO: 515 - DNA, 25 bp, equine
ataccaagctgagcggatgccagag

SEQ ID NO: 516 - DNA, 25 bp, equine
gtggacccaaagcagctggctgttt

SEQ ID NO: 517 - DNA, 25 bp, equine
atgtgcctggctttttgcctacaaa

SEQ ID NO: 518 - DNA, 25 bp, equine
aacgatttaagtcagcccacaggat

SEQ ID NO: 519 - DNA, 25 bp, equine
cacaggatttttagctcagcccatg

SEQ ID NO: 520 - DNA, 25 bp, equine
gaactggagcagcacctacatgcca

SEQ ID NO: 521 - DNA, 25 bp, equine
tgaaccctcaagctcaggctcttag

SEQ ID NO: 522 - DNA, 25 bp, equine
attgttgacatttagctctgcctgc

SEQ ID NO: 523 - DNA, 25 bp, equine
ttttctcttcttccatggctaatca

SEQ ID NO: 524 - DNA, 25 bp, equine
aggacctctcatcatctcaaggtga

SEQ ID NO: 525 - DNA, 25 bp, equine
gactacagttgtggtcacccttggc

SEQ ID NO: 526 - DNA, 25 bp, equine
tgccttcccagcttagatctttgaa

SEQ ID NO: 527 - DNA, 25 bp, equine
accacctttgtatcctttttgctag

SEQ ID NO: 528 - DNA, 25 bp, equine
aatggcatcttttactcagtcacaa

SEQ ID NO: 529 - DNA, 25 bp, equine
aacaaactcttagccattccctatt

SEQ ID NO: 530 - DNA, 25 bp, equine
ggcatttaaattcccaggcaggtac

SEQ ID NO: 531 - DNA, 25 bp, equine
aggtaccctctctgtggctagaaat

SEQ ID NO: 532 - DNA, 25 bp, equine
gttctttacagccattgttcttgtg

SEQ ID NO: 533 - DNA, 25 bp, equine
agaattccagctgcagcggttcgat

SEQ ID NO: 534 - DNA, 25 bp, equine
ggttcgatgcggaagccgcgccaat

SEQ ID NO: 535 - DNA, 25 bp, equine
gctcgcgaaataggcgtccgattcc

SEQ ID NO: 536 - DNA, 25 bp, equine
gattcctcccgtgtgacgggactca

SEQ ID NO: 537 - DNA, 25 bp, equine
ggcccagggacttccagtgcagcac

SEQ ID NO: 538 - DNA, 25 bp, equine
ccttggccgattcggcattggtgta

SEQ ID NO: 539 - DNA, 25 bp, equine
cattggtgtagaagacgagtccccg

SEQ ID NO: 540 - DNA, 25 bp, equine
ggatcgaggcccttcagcagcacca

SEQ ID NO: 541 - DNA, 25 bp, equine
gggtccgacgacaatgtgaagtcct

SEQ ID NO: 542 - DNA, 25 bp, equine
tctcttaaccgatcgatggccattt

SEQ ID NO: 543 - DNA, 25 bp, equine
atggccattttcttccctgtggcag

SEQ ID NO: 544 - DNA, 25 bp, equine
gtcctgaccctgtgctggtgaatgg

SEQ ID NO: 545 - DNA, 25 bp, equine
ggactacatcctcaagggcagcaat

SEQ ID NO: 546 - DNA, 25 bp, equine
gcagcaattggagccagtgcctaga

SEQ ID NO: 547 - DNA, 25 bp, equine
agtgcctagaggaccacacctggat

SEQ ID NO: 548 - DNA, 25 bp, equine
aaaagcagacactgtggccatcccg

SEQ ID NO: 549 - DNA, 25 bp, equine
gggtatccagctcatggctgtttta

SEQ ID NO: 550 - DNA, 25 bp, equine
ggagaagacttcacctcaggatcta

SEQ ID NO: 551 - DNA, 25 bp, equine
acttagtgggcacacgggaccaaca

SEQ ID NO: 552 - DNA, 25 bp, equine
acttccagtctgtgagttgatccaa

SEQ ID NO: 553 - DNA, 25 bp, equine
cagctccacagaccgagtgcgagaa

SEQ ID NO: 554 - DNA, 25 bp, equine
tgttgccctgacattgtagctaaac

SEQ ID NO: 555 - DNA, 25 bp, equine
ttccacacctaccttagactttaat

SEQ ID NO: 556 - DNA, 25 bp, equine
gaacctcagccattttcaattacag

SEQ ID NO: 557 - DNA, 25 bp, equine
aaacttcactccgtgtgtagggacg

SEQ ID NO: 558 - DNA, 25 bp, equine
taggataggttgtctgcacctccca

SEQ ID NO: 559 - DNA, 25 bp, equine
agaattcttgctcccttgctgctgt

SEQ ID NO: 560 - DNA, 25 bp, equine
atactaaaggatggccagctgcttc

SEQ ID NO: 561 - DNA, 25 bp, equine
ggttttcatttactgcagctgctag

SEQ ID NO: 562 - DNA, 25 bp, equine
ggaattgcactcagacgtgacattt

SEQ ID NO: 563 - DNA, 25 bp, equine
gtgacatttcagttcatctctgcta

SEQ ID NO: 564 - DNA, 25 bp, equine
ctatgtgtcagttctgtcagctgca

SEQ ID NO: 565 - DNA, 25 bp, equine
gtcagctgcaggttcttgtataatg

SEQ ID NO: 566 - DNA, 25 bp, equine
tgaaggctagacatgtggcacccag

SEQ ID NO: 567 - DNA, 25 bp, equine
ggcacccagcgatacagttcttatg

SEQ ID NO: 568 - DNA, 25 bp, equine
cttatgtttaatgtggccttggtcc

SEQ ID NO: 569 - DNA, 25 bp, equine
gtggccttggtcctacaaagattag

SEQ ID NO: 570 - DNA, 25 bp, equine
aaagattagctacctctgtcctgaa

SEQ ID NO: 571 - DNA, 25 bp, equine
ggagcttgcacatagatacttcagt

SEQ ID NO: 572 - DNA, 25 bp, equine
aaatgagattcgatttggccctcgc

SEQ ID NO: 573 - DNA, 25 bp, equine
ctcgctgctacagaagccaggcaat

SEQ ID NO: 574 - DNA, 25 bp, equine
gccaggcaatgctctgacttactga

SEQ ID NO: 575 - DNA, 25 bp, equine
agtaccatgtggctcgggcacgcaa

SEQ ID NO: 576 - DNA, 25 bp, equine
gaaacttttggaacagagggctcag

SEQ ID NO: 577 - DNA, 25 bp, equine
agtttaccaccctccagaagatagt

SEQ ID NO: 578 - DNA, 25 bp, equine
ccaggtcaggaactcggctacagaa

SEQ ID NO: 579 - DNA, 25 bp, equine
acagaagccctcttgtggctgaaga

SEQ ID NO: 580 - DNA, 25 bp, equine
ggacatccagacagccttgaataac

SEQ ID NO: 581 - DNA, 25 bp, equine
gggcagctccatcctatgaagattt

SEQ ID NO: 582 - DNA, 25 bp, equine
atgaagattttgtggccgcgttaac

SEQ ID NO: 583 - DNA, 25 bp, equine
aggtgaccaccagaaagcagctttc

SEQ ID NO: 584 - DNA, 25 bp, equine
gatgcagagggatctcagcctttac

SEQ ID NO: 585 - DNA, 25 bp, equine
agctggcgatactggacactttata

SEQ ID NO: 586 - DNA, 25 bp, equine
acactttatacgaggtccacggact

SEQ ID NO: 587 - DNA, 25 bp, equine
tatgacgtctgcaggacagggccac

SEQ ID NO: 588 - DNA, 25 bp, equine
aagaaggccgggtctgtttctcttg

SEQ ID NO: 589 - DNA, 25 bp, equine
gtttctcttggtacccttcagagta

SEQ ID NO: 590 - DNA, 25 bp, equine
gaagatttcctgttacacggctctc

SEQ ID NO: 591 - DNA, 25 bp, equine
ggctctccctcaaatacaattacaa

SEQ ID NO: 592 - DNA, 25 bp, equine
gcacctgttgagcatctgtgaccaa

SEQ ID NO: 593 - DNA, 25 bp, equine
gaattgtcccaggatccttactaag

SEQ ID NO: 594 - DNA, 25 bp, equine
aagggtgtttcagctgattcgccac

SEQ ID NO: 595 - DNA, 25 bp, equine
tttgggttccttggtttcatcgccg

SEQ ID NO: 596 - DNA, 25 bp, equine
cttgggtcccactgaactttgtgaa

SEQ ID NO: 597 - DNA, 25 bp, equine
ttgtgaattcctgtgttcgcatctt

SEQ ID NO: 598 - DNA, 25 bp, equine
atcttctgttcctggaaggtgtcct

SEQ ID NO: 599 - DNA, 25 bp, equine
tgtcctgcaggaacccaagcttgaa

SEQ ID NO: 600 - DNA, 25 bp, equine
aagcttgaacccagcggctgctaca

SEQ ID NO: 601 - DNA, 25 bp, equine
aagagtcacaaactgtctccatcac

SEQ ID NO: 602 - DNA, 25 bp, equine
gagctggccctcaacgagctggtga

SEQ ID NO: 603 - DNA, 25 bp, equine
gcttcagccctaaggaggtgttggt

SEQ ID NO: 604 - DNA, 25 bp, equine
tgctctggctgcaagggcacgagaa

SEQ ID NO: 605 - DNA, 25 bp, equine
aagctgccccgcgagaagtacctgg

SEQ ID NO: 606 - DNA, 25 bp, equine
gaagtacctggtctttaagcccctg

SEQ ID NO: 607 - DNA, 25 bp, equine
agacgtcttctcctgcatggtgggc

SEQ ID NO: 608 - DNA, 25 bp, equine
gagcttcacccagaagtctatcgac

SEQ ID NO: 609 - DNA, 25 bp, equine
atgtcaacgtgtccgtggtcatggc

SEQ ID NO: 610 - DNA, 25 bp, equine
tgtcatacagtgtccaaaaccccag

SEQ ID NO: 611 - DNA, 25 bp, equine
gcgacaagaacctcattgactccat

SEQ ID NO: 612 - DNA, 25 bp, equine
ttgactccatggaccaagcagcctt

SEQ ID NO: 613 - DNA, 25 bp, equine
gaaccccaaatttgagaggctcctg

SEQ ID NO: 614 - DNA, 25 bp, equine
aaaagtgaggttcccagacatgccg

SEQ ID NO: 615 - DNA, 25 bp, equine
attgttgtgatttctgctgctgccc

SEQ ID NO: 616 - DNA, 25 bp, equine
ttatcgtccccaggagggtccttgg

SEQ ID NO: 617 - DNA, 25 bp, equine
gcctggctgggctcttatggtactt

SEQ ID NO: 618 - DNA, 25 bp, equine
tatggtacttcctctgtgaactgtg

SEQ ID NO: 619 - DNA, 25 bp, equine
actgtgtgtgaatttgcctttcctc

SEQ ID NO: 620 - DNA, 25 bp, equine
aaatcctgtgttttgttacttgaat

SEQ ID NO: 621 - DNA, 25 bp, equine
aaagcagtgatacctccagagcagt

SEQ ID NO: 622 - DNA, 25 bp, equine
agcagtgagctctctcggcacctaa

SEQ ID NO: 623 - DNA, 25 bp, equine
tcggcacctaagcagtgctttctat

SEQ ID NO: 624 - DNA, 25 bp, equine
tttctatactgttcctcaccaaaag

SEQ ID NO: 625 - DNA, 25 bp, equine
aagaaccagtgctccctggagaaat

SEQ ID NO: 626 - DNA, 25 bp, equine
atggctgattccatgtcaggagctt

SEQ ID NO: 627 - DNA, 25 bp, equine
aaagtaaaactgagcctgggacatc

SEQ ID NO: 628 - DNA, 25 bp, equine
gcctgggacatcttgttgggccaaa

SEQ ID NO: 629 - DNA, 25 bp, equine
gaatagtgctcacagacaactttga

SEQ ID NO: 630 - DNA, 25 bp, equine
taaaagggctcccactggacacatt

SEQ ID NO: 631 - DNA, 25 bp, equine
ggacacattcagtacagtttgagca

SEQ ID NO: 632 - DNA, 25 bp, equine
gaaatgttgtacctatctgggcact

SEQ ID NO: 633 - DNA, 25 bp, equine
gttgtacctatctgggcactacaga

SEQ ID NO: 634 - DNA, 25 bp, equine
gcactacagaagatgcataggcctt

SEQ ID NO: 635 - DNA, 25 bp, equine
agatgcataggccttccagagctca

SEQ ID NO: 636 - DNA, 25 bp, equine
aggccttccagagctcacagaggaa

SEQ ID NO: 637 - DNA, 25 bp, equine
aatgcttcaagaggcatggtcctca

SEQ ID NO: 638 - DNA, 25 bp, equine
aggcatggtcctcagaaattattct

SEQ ID NO: 639 - DNA, 25 bp, equine
attattctggaatgccgtttcactt

SEQ ID NO: 640 - DNA, 25 bp, equine
ggaatgccgtttcacttgtatcaac

SEQ ID NO: 641 - DNA, 25 bp, equine
gccgtttcacttgtatcaacatcat

SEQ ID NO: 642 - DNA, 25 bp, equine
tcaacatcatgttcctggttcagtt

SEQ ID NO: 643 - DNA, 25 bp, equine
gggcctccagcctttgccgcaagtg

SEQ ID NO: 644 - DNA, 25 bp, equine
agcctttgccgcaagtgcctcggtg

SEQ ID NO: 645 - DNA, 25 bp, equine
caagtgcctcggtgcccgctgggtc

SEQ ID NO: 646 - DNA, 25 bp, equine
cccaccgcaaggaggactcaggaca

SEQ ID NO: 647 - DNA, 25 bp, equine
aaggaggactcaggacagccctcca

SEQ ID NO: 648 - DNA, 25 bp, equine
acccacagagcttttcctcctggac

SEQ ID NO: 649 - DNA, 25 bp, equine
gccgccggaaggaaagagcttgccc

SEQ ID NO: 650 - DNA, 25 bp, equine
gaaggaaagagcttgcccgctccta

SEQ ID NO: 651 - DNA, 25 bp, equine
ttgcccgctcctacaggacgtttat

SEQ ID NO: 652 - DNA, 25 bp, equine
gctcctacaggacgtttatttttct

SEQ ID NO: 653 - DNA, 25 bp, equine
caggacgtttatttttctcttgcca

SEQ ID NO: 654 - DNA, 25 bp, equine
gccaggagacggtcgcccagatcaa

SEQ ID NO: 655 - DNA, 25 bp, equine
gaaagtcagaggtcagactcccaag

SEQ ID NO: 656 - DNA, 25 bp, equine
cagaggtcagactcccaaggtggcc

SEQ ID NO: 657 - DNA, 25 bp, equine
agggcatcgctgcagaagatcaagt

SEQ ID NO: 658 - DNA, 25 bp, equine
gatcaagtcgtgctcttggcaggca

SEQ ID NO: 659 - DNA, 25 bp, equine
gcccctggaggatgaggctactctg

SEQ ID NO: 660 - DNA, 25 bp, equine
ggaggctctgaccactctggaagta

SEQ ID NO: 661 - DNA, 25 bp, equine
tgaccactctggaagtagccggccg

SEQ ID NO: 662 - DNA, 25 bp, equine
agccggccgcatgcttggaggtaaa

SEQ ID NO: 663 - DNA, 25 bp, equine
gaggtaaagtccatggctccctagc

SEQ ID NO: 664 - DNA, 25 bp, equine
cctagcccgtgctgggaaagtcaga

SEQ ID NO: 665 - DNA, 25 bp, equine
gcagatgccagcttcagtttagaga

SEQ ID NO: 666 - DNA, 25 bp, equine
gaatgaagctcgtggttcgcagact

SEQ ID NO: 667 - DNA, 25 bp, equine
gttcgcagactgtctcaacagcatt

SEQ ID NO: 668 - DNA, 25 bp, equine
ataacatgttcaagtgcgcctagtg

SEQ ID NO: 669 - DNA, 25 bp, equine
gcctagtgtttttgctaccacaatc

SEQ ID NO: 670 - DNA, 25 bp, equine
tggaaactctttcttcatgtacaga

SEQ ID NO: 671 - DNA, 25 bp, equine
gaagcctcaagtgacctgtttttaa

SEQ ID NO: 672 - DNA, 25 bp, equine
gtggacaataactttcccttcccag

SEQ ID NO: 673 - DNA, 25 bp, equine
tcccagtggttctcatcttaacgta

SEQ ID NO: 674 - DNA, 25 bp, equine
tcgaatcttatgtgacccatctctt

SEQ ID NO: 675 - DNA, 25 bp, equine
gacccatctcttcttgaatcttttt

SEQ ID NO: 676 - DNA, 25 bp, equine
gggcatgtgcctccatcagacacag

SEQ ID NO: 677 - DNA, 25 bp, equine
atcagacacagccaagctctcctgg

SEQ ID NO: 678 - DNA, 25 bp, equine
gctctgacctacagctttgtgttga

SEQ ID NO: 679 - DNA, 25 bp, equine
atagcttgcggcaggtggcacatgc

SEQ ID NO: 680 - DNA, 25 bp, equine
gtggcacatgccacgcagacgaggc

SEQ ID NO: 681 - DNA, 25 bp, equine
ggaagtgcatcagaccagcggccat

SEQ ID NO: 682 - DNA, 25 bp, equine
gcaaagttcagtgggcagcgcagca

SEQ ID NO: 683 - DNA, 25 bp, equine
atggtgcccctgtaggcctctggga

SEQ ID NO: 684 - DNA, 25 bp, equine
cagcaggcaggagacggccaagcca

SEQ ID NO: 685 - DNA, 25 bp, equine
ttggcttcggcctccttaagaaagg

SEQ ID NO: 686 - DNA, 25 bp, equine
ttaagaaagggagacactgcccgca

SEQ ID NO: 687 - DNA, 25 bp, equine
acatcttttgccttgttcatggtca

SEQ ID NO: 688 - DNA, 25 bp, equine
ggtcatctggatcatcttttacact

SEQ ID NO: 689 - DNA, 25 bp, equine
tacactgccatccactatgactgat

SEQ ID NO: 690 - DNA, 25 bp, equine
atgactgatggtgtacaggccccac

SEQ ID NO: 691 - DNA, 25 bp, equine
gaccctcttacttacagcacagaaa

SEQ ID NO: 692 - DNA, 25 bp, equine
aagacccatgtttcctggactgaga

SEQ ID NO: 693 - DNA, 25 bp, equine
gattattcatcaccaaccatttctt

SEQ ID NO: 694 - DNA, 25 bp, equine
gaaacacctgtttgctgattggagc

SEQ ID NO: 695 - DNA, 25 bp, equine
gatgcacctctggatccggatgaaa

SEQ ID NO: 696 - DNA, 25 bp, equine
attaaattgtcttcctcacttccgt

SEQ ID NO: 697 - DNA, 25 bp, equine
tcacttccgtcaggtgtacagtttt

SEQ ID NO: 698 - DNA, 25 bp, equine
ggacgtgcccaagcagaactcgcag

SEQ ID NO: 699 - DNA, 25 bp, equine
gagcgcttccagaacctcgacagga

SEQ ID NO: 700 - DNA, 25 bp, equine
ggtctggactcgctgcacaagaaca

SEQ ID NO: 701 - DNA, 25 bp, equine
agaacagcgtcagccagatctcggt

SEQ ID NO: 702 - DNA, 25 bp, equine
gggaaaggccaagtgctcgcagttc

SEQ ID NO: 703 - DNA, 25 bp, equine
gcagttctgcactacgggcatggac

SEQ ID NO: 704 - DNA, 25 bp, equine
gagcttggaatcagccttgaaggac

SEQ ID NO: 705 - DNA, 25 bp, equine
tgacctgccaggattatgttgccct

SEQ ID NO: 706 - DNA, 25 bp, equine
acggtcgctttgctgaatgtttcta

SEQ ID NO: 707 - DNA, 25 bp, equine
gtgggaagcttttcttacctgttga

SEQ ID NO: 708 - DNA, 25 bp, equine
tgaaggaacacgtgcctttttctta

SEQ ID NO: 709 - DNA, 25 bp, equine
tcccagcgagaaccaacactgagtc

SEQ ID NO: 710 - DNA, 25 bp, equine
ggaacctggcactttcgtcggcagc

SEQ ID NO: 711 - DNA, 25 bp, equine
tttcgtcggcagctgcagcttctgg

SEQ ID NO: 712 - DNA, 25 bp, equine
ttctggctgcttttttggaggttct

SEQ ID NO: 713 - DNA, 25 bp, equine
tttggaggttcttggcctggaccca

SEQ ID NO: 714 - DNA, 25 bp, equine
tcttggcctggacccatgggcttcg

SEQ ID NO: 715 - DNA, 25 bp, equine
cgtgccatgccatactgtcactcag

SEQ ID NO: 716 - DNA, 25 bp, equine
tgtcactcagccacatcagtgtttg

SEQ ID NO: 717 - DNA, 25 bp, equine
acatcagtgtttgtcccaccaaggg

SEQ ID NO: 718 - DNA, 25 bp, equine
agtgtttgtcccaccaagggaggtg

SEQ ID NO: 719 - DNA, 25 bp, equine
atgggtcacccacatctgtgcttgg

SEQ ID NO: 720 - DNA, 25 bp, equine
aagaagtgctcagcagcgacactgc

SEQ ID NO: 721 - DNA, 25 bp, equine
taggctctcttgtgtccgtcatgtg

SEQ ID NO: 722 - DNA, 25 bp, equine
gtccgtcatgtgcttgtgaacacta

SEQ ID NO: 723 - DNA, 25 bp, equine
ctaaattgtgagacagcagcctgtg

SEQ ID NO: 724 - DNA, 25 bp, equine
acaagatttgttcacgtctcaaccc

SEQ ID NO: 725 - DNA, 25 bp, equine
gtgtctgcattagtattggcatact

SEQ ID NO: 726 - DNA, 25 bp, equine
tgacctgtgttctcttccctgattg

SEQ ID NO: 727 - DNA, 25 bp, equine
ccctgattgactgttccagcagaga

SEQ ID NO: 728 - DNA, 25 bp, equine
atgtctttacttcatgctccactga

SEQ ID NO: 729 - DNA, 25 bp, equine
gagctgcagtttcttagtgccttat

SEQ ID NO: 730 - DNA, 25 bp, equine
aattcttgccatgagggattgacgg

SEQ ID NO: 731 - DNA, 25 bp, equine
ccgccgaagcggagttgtgtgaact

SEQ ID NO: 732 - DNA, 25 bp, equine
cagcccctcatttctttttgatgaa

SEQ ID NO: 733 - DNA, 25 bp, equine
aagattgtctctgataagtggctca

SEQ ID NO: 734 - DNA, 25 bp, equine
ataagtggctcagaagctcccatct

SEQ ID NO: 735 - DNA, 25 bp, equine
agaagctcccatctgctggtgcagg

SEQ ID NO: 736 - DNA, 25 bp, equine
ggtgcagggttttctgaggctcttc

SEQ ID NO: 737 - DNA, 25 bp, equine
tttctgaggctcttcttcctgagca

SEQ ID NO: 738 - DNA, 25 bp, equine
actccgtgcttttcgtgtgcgtacc

SEQ ID NO: 739 - DNA, 25 bp, equine
gcctccacatcaagggacagtttgt

SEQ ID NO: 740 - DNA, 25 bp, equine
cagtttgtttgtgcttgtttttcta

SEQ ID NO: 741 - DNA, 25 bp, equine
ctaatgacataaattccctgaagag

SEQ ID NO: 742 - DNA, 25 bp, equine
tcagagaaaatgctgccgcaacctc

SEQ ID NO: 743 - DNA, 25 bp, equine
tgcttccagggctgtacatagttgg

SEQ ID NO: 744 - DNA, 25 bp, equine
actgcgtgggtcaactcagtgtcca

SEQ ID NO: 745 - DNA, 25 bp, equine
tcagtgtccacttcgatgcttgtat

SEQ ID NO: 746 - DNA, 25 bp, equine
cttcgatgcttgtatgtttgggttt

SEQ ID NO: 747 - DNA, 25 bp, equine
gtttgggtttcgcatcttcattaaa

SEQ ID NO: 748 - DNA, 25 bp, equine
gggcagctcagatcagcctgggcca

SEQ ID NO: 749 - DNA, 25 bp, equine
ggatgaaccctcagggcagggcaca

SEQ ID NO: 750 - DNA, 25 bp, equine
agagctggccctgcattcgcctgga

SEQ ID NO: 751 - DNA, 25 bp, equine
gaccctgagccgtccatggaagcag

SEQ ID NO: 752 - DNA, 25 bp, equine
atggaagcagggaccttttctcccg

SEQ ID NO: 753 - DNA, 25 bp, equine
aagattataccattcccttggaata

SEQ ID NO: 754 - DNA, 25 bp, equine
gaatattttcttcctaatgtcagag

SEQ ID NO: 755 - DNA, 25 bp, equine
atgtcagagcttttcctgcattatt

SEQ ID NO: 756 - DNA, 25 bp, equine
gctttctgagttgggatgctttgac

SEQ ID NO: 757 - DNA, 25 bp, equine
gtatcacctatttttaaagctgctt

SEQ ID NO: 758 - DNA, 25 bp, equine
aaagctgctttgttaggttccttat

SEQ ID NO: 759 - DNA, 25 bp, equine
gttccttatgttttaactgtcttag

SEQ ID NO: 760 - DNA, 25 bp, equine
gtcttagtttccatttcattctctt

SEQ ID NO: 761 - DNA, 25 bp, equine
atcaacttcatggtcttgtttttac

SEQ ID NO: 762 - DNA, 25 bp, equine
gtattgcatgtatttaggacctatc

SEQ ID NO: 763 - DNA, 25 bp, equine
aagtgtcctattcactacttgttaa

SEQ ID NO: 764 - DNA, 25 bp, equine
gaaaatgtatgcctgcgccaagttt

SEQ ID NO: 765 - DNA, 25 bp, equine
tgctgagccgatcactgtctgcagt

SEQ ID NO: 766 - DNA, 25 bp, equine
gaaacgaccggagacactgacagat

SEQ ID NO: 767 - DNA, 25 bp, equine
gatgagaccctcagcagcttggcag

SEQ ID NO: 768 - DNA, 25 bp, equine
aaaccagcgccatttcaagggacat

SEQ ID NO: 769 - DNA, 25 bp, equine
gggacatcgacacagcagccaagtt

SEQ ID NO: 770 - DNA, 25 bp, equine
ttgggactgtatttgggagcctcat

SEQ ID NO: 771 - DNA, 25 bp, equine
ggagcctcatcattggttatgccag

SEQ ID NO: 772 - DNA, 25 bp, equine
ttatgccaggaacccttctctgaag

SEQ ID NO: 773 - DNA, 25 bp, equine
tttgcctgatggtggcctttctcat

SEQ ID NO: 774 - DNA, 25 bp, equine
ttcgccatgtgaagaagccgtctcc

SEQ ID NO: 775 - DNA, 25 bp, equine
cacgagggaagagggtctccttcca

SEQ ID NO: 776 - DNA, 25 bp, equine
gaacaatttaatttcttggccgtgt

SEQ ID NO: 777 - DNA, 25 bp, equine
ggccgtgtttagtaacagttcctat

SEQ ID NO: 778 - DNA, 25 bp, equine
acagttcctatgcatggtttttaac

SEQ ID NO: 779 - DNA, 25 bp, equine
acctgattctgcctctttaatgaat

SEQ ID NO: 780 - DNA, 25 bp, equine
gaaactcaatgccttatgtgctcac

SEQ ID NO: 781 - DNA, 25 bp, equine
ttatgtgctcactcagtttcccttc

SEQ ID NO: 782 - DNA, 25 bp, equine
agtttcccttctgcagcttgttttt

SEQ ID NO: 783 - DNA, 25 bp, equine
gcttgttttttctcactatctgtat

SEQ ID NO: 784 - DNA, 25 bp, equine
atgctggcaaaacctctaagactgt

SEQ ID NO: 785 - DNA, 25 bp, equine
gaaagttgatttgtcctagtgcaaa

SEQ ID NO: 786 - DNA, 25 bp, equine
agacaggtggctccaagacgtcgtc

SEQ ID NO: 787 - DNA, 25 bp, equine
gacgtcgtcgacagttaagagcacc

SEQ ID NO: 788 - DNA, 25 bp, equine
aagagcaccccgtctgggaagaggt

SEQ ID NO: 789 - DNA, 25 bp, equine
ggtacaagtttgtggccaccggaca

SEQ ID NO: 790 - DNA, 25 bp, equine
gtagacgaaggctcggcaccctagg

SEQ ID NO: 791 - DNA, 25 bp, equine
tggcctgccgaagaagctgcttcca

SEQ ID NO: 792 - DNA, 25 bp, equine
tggctctgcctcttataagctcagg

SEQ ID NO: 793 - DNA, 25 bp, equine
taagctcaggctggcagctggctaa

SEQ ID NO: 794 - DNA, 25 bp, equine
aactcccaaggaaggtgcagcctgt

SEQ ID NO: 795 - DNA, 25 bp, equine
ggacctcatggtcaagagccagtga

SEQ ID NO: 796 - DNA, 25 bp, equine
tgagctggatgcttaggccctacat

SEQ ID NO: 797 - DNA, 25 bp, equine
agtttcatcatcagggtccgggtgg

SEQ ID NO: 798 - DNA, 25 bp, equine
taggttgtcagggtttactgccttc

SEQ ID NO: 799 - DNA, 25 bp, equine
ttagctcttttttccctgcattcta

SEQ ID NO: 800 - DNA, 25 bp, equine
ccctgcattctagcaattcgtgatt

SEQ ID NO: 801 - DNA, 25 bp, equine
gggaagaagcaagacctctcctcag

SEQ ID NO: 802 - DNA, 25 bp, equine
agactttgtctctgggtttcatcct

SEQ ID NO: 803 - DNA, 25 bp, equine
ctgtcactctaggagggttcgtgct

SEQ ID NO: 804 - DNA, 25 bp, equine
gaagagacattagctccttgttccc

SEQ ID NO: 805 - DNA, 25 bp, equine
ttttccccacgggtttggtgcacag

SEQ ID NO: 806 - DNA, 25 bp, equine
ttcccatgtccgctcagatgaggat

SEQ ID NO: 807 - DNA, 25 bp, equine
ttttttcttttcttgcctgacctca

SEQ ID NO: 808 - DNA, 25 bp, equine
tatgctctgtgtataaggatgaatt

SEQ ID NO: 809 - DNA, 25 bp, equine
gagttgtcattttctcttcactgga

SEQ ID NO: 810 - DNA, 25 bp, equine
gtcattttctcttcactggatgttt

SEQ ID NO: 811 - DNA, 25 bp, equine
tctcttcactggatgtttatttata

SEQ ID NO: 812 - DNA, 25 bp, equine
agatttgacctgttcatgcgtctgt

SEQ ID NO: 813 - DNA, 25 bp, equine
gttcatgcgtctgtggagcagccct

SEQ ID NO: 814 - DNA, 25 bp, equine
tccgtctcccggctatatagtaatc

SEQ ID NO: 815 - DNA, 25 bp, equine
gtaatcttaggtagagtgttgcctt

SEQ ID NO: 816 - DNA, 25 bp, equine
tagagtgttgccttgtgggttaccg

SEQ ID NO: 817 - DNA, 25 bp, equine
tgggttaccgtttgctctgagactt

SEQ ID NO: 818 - DNA, 25 bp, equine
tctgagacttctcggatggacccac

SEQ ID NO: 819 - DNA, 25 bp, equine
atgttcagttctaaggagtcccagc

SEQ ID NO: 820 - DNA, 25 bp, equine
atgcccaaacgtggcctggaggtga

SEQ ID NO: 821 - DNA, 25 bp, equine
gattgccagattctacaagctgcac

SEQ ID NO: 822 - DNA, 25 bp, equine
agcggaggtgtgagcccattgccat

SEQ ID NO: 823 - DNA, 25 bp, equine
ccattgccatgacagtgcctagaaa

SEQ ID NO: 824 - DNA, 25 bp, equine
tagaaagtcggacctgttccaggag

SEQ ID NO: 825 - DNA, 25 bp, equine
atttccctcaaggatggctacgtgc

SEQ ID NO: 826 - DNA, 25 bp, equine
agacagcaccagaggccagtggcac

SEQ ID NO: 827 - DNA, 25 bp, equine
ggcactcctagctcggatgctgtat

SEQ ID NO: 828 - DNA, 25 bp, equine
agatgaggaagctccaggccactgt

SEQ ID NO: 829 - DNA, 25 bp, equine
aggccactgtgcaggagctacagaa

SEQ ID NO: 830 - DNA, 25 bp, equine
ggagctgctgttcttcagacagaga

SEQ ID NO: 831 - DNA, 25 bp, equine
gactctgaggctgctccacaagtac

SEQ ID NO: 832 - DNA, 25 bp, equine
ataagggcgccatcaagttcgtgct

SEQ ID NO: 833 - DNA, 25 bp, equine
aagacacggtggtcgcgatcatggc

SEQ ID NO: 834 - DNA, 25 bp, equine
gaaggtcaacaaaggcatcggcatt

SEQ ID NO: 835 - DNA, 25 bp, equine
gcatcggcattgaaaacatccacta

SEQ ID NO: 836 - DNA, 25 bp, equine
aatgagcctgccaaggagtgcgctt

SEQ ID NO: 837 - DNA, 25 bp, equine
aaaggaatgcgcttgggctccagac

SEQ ID NO: 838 - DNA, 25 bp, equine
aatgcgcttggactcaatgtggact

SEQ ID NO: 839 - DNA, 25 bp, equine
aatgtggactctgctgtatctgtgt

SEQ ID NO: 840 - DNA, 25 bp, equine
tgtccgtgtctgtgtgtgacagcat

SEQ ID NO: 841 - DNA, 25 bp, equine
gaaagggtgcctgttgtcaataaac

SEQ ID NO: 842 - DNA, 25 bp, equine
gagctatggcgcctccaatgaagga

SEQ ID NO: 843 - DNA, 25 bp, equine
caatgaaggatctgcccaggtggct

SEQ ID NO: 844 - DNA, 25 bp, equine
atttgcagttgctccagactggact

SEQ ID NO: 845 - DNA, 25 bp, equine
taagcagtctggttttgttcccgag

SEQ ID NO: 846 - DNA, 25 bp, equine
gagtcgatgtttgaccggcttctca

SEQ ID NO: 847 - DNA, 25 bp, equine
tgtggcctccactgcaggaatcaac

SEQ ID NO: 848 - DNA, 25 bp, equine
gaatcaaccctctgctggtgaacag

SEQ ID NO: 849 - DNA, 25 bp, equine
gcctgtttgctggaatggacctgac

SEQ ID NO: 850 - DNA, 25 bp, equine
ttcagaatctccagaatctccagtc

SEQ ID NO: 851 - DNA, 25 bp, equine
gggcctgcccaacatgtttggattg

SEQ ID NO: 852 - DNA, 25 bp, equine
tgagttcgtcatcagggccaagttc

SEQ ID NO: 853 - DNA, 25 bp, equine
agaccaccttacagcggcgttatga

SEQ ID NO: 854 - DNA, 25 bp, equine
tgcggatacttccacaggtcggaga

SEQ ID NO: 855 - DNA, 25 bp, equine
gaaccgcagcgaggagtttctcatc

SEQ ID NO: 856 - DNA, 25 bp, equine
ttctcatcgccggacaactattgga

SEQ ID NO: 857 - DNA, 25 bp, equine
ggacgagaagctgtacatcaccacc

SEQ ID NO: 858 - DNA, 25 bp, equine
gaatgctcagtgtttccctgttcat

SEQ ID NO: 859 - DNA, 25 bp, equine
tgattgcttgtggacggaccagctc

SEQ ID NO: 860 - DNA, 25 bp, equine
acaggctctgacaagggcttccaga

SEQ ID NO: 861 - DNA, 25 bp, equine
gaatcctgtctccagcagaagctga

SEQ ID NO: 862 - DNA, 25 bp, equine
agctgaagcttgcacagtgttcacc

SEQ ID NO: 863 - DNA, 25 bp, equine
gcttcctggagctggcataccgtgg

SEQ ID NO: 864 - DNA, 25 bp, equine
agctggcataccgtggtctgcgcta

SEQ ID NO: 865 - DNA, 25 bp, equine
gaaagaagccccagagccctgggtg

SEQ ID NO: 866 - DNA, 25 bp, equine
ggtgcttccctccactttcaagttt

SEQ ID NO: 867 - DNA, 25 bp, equine
tttcaagtttcattctcctgcctgt

SEQ ID NO: 868 - DNA, 25 bp, equine
cattctcctgcctgtagcagggaga

SEQ ID NO: 869 - DNA, 25 bp, equine
gagaaaaagctcctgtcttcctgtc

SEQ ID NO: 870 - DNA, 25 bp, equine
ttcctgtcccctggactgggaggta

SEQ ID NO: 871 - DNA, 25 bp, equine
agtattaattcctgtgactgctccc

SEQ ID NO: 872 - DNA, 25 bp, equine
ctggcccagctctgtggtgggcact

SEQ ID NO: 873 - DNA, 25 bp, equine
actgggaagagcctcagtggacccc

SEQ ID NO: 874 - DNA, 25 bp, equine
aatgcggtggcatctttacagatac

SEQ ID NO: 875 - DNA, 25 bp, equine
ttttaaatctccaggcttcccaaat

SEQ ID NO: 876 - DNA, 25 bp, equine
taaccaagtctgctactggcacatc

SEQ ID NO: 877 - DNA, 25 bp, equine
actcaagtatggtcagcgtattcac

SEQ ID NO: 878 - DNA, 25 bp, equine
gcgtattcacctgagttttctggac

SEQ ID NO: 879 - DNA, 25 bp, equine
aggttgcttggctgactatgttgaa

SEQ ID NO: 880 - DNA, 25 bp, equine
ctaagcgatgcttcggtgaccgcag

SEQ ID NO: 881 - DNA, 25 bp, equine
gtgaccgcaggaggtttccaaatca

SEQ ID NO: 882 - DNA, 25 bp, equine
tacaagcactacttctacgggaaat

SEQ ID NO: 883 - DNA, 25 bp, equine
tatggttgtctcttttggaacccct

SEQ ID NO: 884 - DNA, 25 bp, equine
gaacccctttgatctcagttttgta

SEQ ID NO: 885 - DNA, 25 bp, equine
tggcaatcctcagtacacgtacaac

SEQ ID NO: 886 - DNA, 25 bp, equine
gtacaacaattggtctcctccggtg

SEQ ID NO: 887 - DNA, 25 bp, equine
tttcctggagagatcgcatagcgct

SEQ ID NO: 888 - DNA, 25 bp, equine
tagcgctaggatgacacttgcaaaa

SEQ ID NO: 889 - DNA, 25 bp, equine
aaaagcttgtgaactctgtccagag

SEQ ID NO: 890 - DNA, 25 bp, equine
agatgaccaagatgccccagatgag

SEQ ID NO: 891 - DNA, 25 bp, equine
cctggctctcagtatcagcagaata

SEQ ID NO: 892 - DNA, 25 bp, equine
gcagtgaagaagtagccccgcctca

SEQ ID NO: 893 - DNA, 25 bp, equine
aaatgcgcgtagtgaactggttcca

SEQ ID NO: 894 - DNA, 25 bp, equine
aacctttttctgtgtctggctaata

SEQ ID NO: 895 - DNA, 25 bp, equine
gagtttattcactgtcttatctgca

SEQ ID NO: 896 - DNA, 25 bp, equine
ggtttgtttttacttgagcctgcct

SEQ ID NO: 897 - DNA, 25 bp, equine
tgagcctgcctttgtacccttttta

SEQ ID NO: 898 - DNA, 25 bp, equine
gaacagagccacaccggtattatat

SEQ ID NO: 899 - DNA, 25 bp, equine
gttctattgcgtttgctgactaaat

SEQ ID NO: 900 - DNA, 25 bp, equine
aaaagtccacacagctctcctgttt

SEQ ID NO: 901 - DNA, 25 bp, equine
gtctacgttcacagcctcaaaaaag

SEQ ID NO: 902 - DNA, 25 bp, equine
agaacacctccatcctgtgataagt

SEQ ID NO: 903 - DNA, 25 bp, equine
ggattcagctttactcctttgtaac

SEQ ID NO: 904 - DNA, 25 bp, equine
gttaaaaggctgacccacgtggctt

SEQ ID NO: 905 - DNA, 25 bp, equine
acgtggctttgcagtgctgttcgtc

SEQ ID NO: 906 - DNA, 25 bp, equine
gctgttcgtccagaagcatggcaca

SEQ ID NO: 907 - DNA, 25 bp, equine
gaccatccccactttgcagaagagg

SEQ ID NO: 908 - DNA, 25 bp, equine
gtgtgaagtcactggccaaagccgg

SEQ ID NO: 909 - DNA, 25 bp, equine
gacagagtgacccaagcctgaggcc

SEQ ID NO: 910 - DNA, 25 bp, equine
gggtcggctatcagtatcccggcta

SEQ ID NO: 911 - DNA, 25 bp, equine
atcccggctaccgtggataccagta

SEQ ID NO: 912 - DNA, 25 bp, equine
gtggataccagtacctcctggagcc

SEQ ID NO: 913 - DNA, 25 bp, equine
gcgactaccggcactggaacgagtg

SEQ ID NO: 914 - DNA, 25 bp, equine
ttccagccacagatgcaggccgtgc

SEQ ID NO: 915 - DNA, 25 bp, equine
tgcgcgacaggcagtggcaccacaa

SEQ ID NO: 916 - DNA, 25 bp, equine
agtggcaccacaagggcagcttccc

SEQ ID NO: 917 - DNA, 25 bp, equine
aaatgagtccacactccatgcctgt

SEQ ID NO: 918 - DNA, 25 bp, equine
gtactagcccaagcatcatcaatga

SEQ ID NO: 919 - DNA, 25 bp, equine
tggtttattccagctcgagatctcc

SEQ ID NO: 920 - DNA, 25 bp, equine
gagatctcccacaaactatggacca

SEQ ID NO: 921 - DNA, 25 bp, equine
atcagtgatggctcttctctggaag

SEQ ID NO: 922 - DNA, 25 bp, equine
gtggtcaagagcaatctgaacccaa

SEQ ID NO: 923 - DNA, 25 bp, equine
gggccctcttttggtggatgtagca

SEQ ID NO: 924 - DNA, 25 bp, equine
ggatgtagcacaatttccacactgt

SEQ ID NO: 925 - DNA, 25 bp, equine
taaaagctctctcttgtcactgtgt

SEQ ID NO: 926 - DNA, 25 bp, equine
actgtgttacacttatgcattgcca

SEQ ID NO: 927 - DNA, 25 bp, equine
agttttgttagtcttgcatgcttaa

SEQ ID NO: 928 - DNA, 25 bp, equine
gaattggccccatgacttgatgtga

SEQ ID NO: 929 - DNA, 25 bp, equine
atcagtcctgattgctatttaattt

SEQ ID NO: 930 - DNA, 25 bp, equine
tgatgggttttaagtgtctcattaa

SEQ ID NO: 931 - DNA, 25 bp, equine
gagagcactgagtgccaggcactgt

SEQ ID NO: 932 - DNA, 25 bp, equine
gggctccaagcaattagacagcaag

SEQ ID NO: 933 - DNA, 25 bp, equine
gcaagatcactattagagtcagaca

SEQ ID NO: 934 - DNA, 25 bp, equine
gtcagacaaagtgtgtgcacatctt

SEQ ID NO: 935 - DNA, 25 bp, equine
gcaggtcagttgctatttattgaaa

SEQ ID NO: 936 - DNA, 25 bp, equine
acatttttatgttgaagcttccctt

SEQ ID NO: 937 - DNA, 25 bp, equine
gaagcttcccttagacattttatgt

SEQ ID NO: 938 - DNA, 25 bp, equine
gggcataatgcctggtttgatattc

SEQ ID NO: 939 - DNA, 25 bp, equine
tatgcaatgtttctctatctggaac

SEQ ID NO: 940 - DNA, 25 bp, equine
tgatggttcttgttccacgagggcc

SEQ ID NO: 941 - DNA, 25 bp, equine
aagggctgtgagtatcttctctctt

SEQ ID NO: 942 - DNA, 25 bp, equine
gggtgcatttactcagtgcctggca

SEQ ID NO: 943 - DNA, 25 bp, equine
tggtccgtgggagctctgaatgcaa

SEQ ID NO: 944 - DNA, 25 bp, equine
cacgtcggtttaggtcaggtctcaa

SEQ ID NO: 945 - DNA, 25 bp, equine
caggtctcaattcctttctatggga

SEQ ID NO: 946 - DNA, 25 bp, equine
ttcgggccatcaataaatcagtact

SEQ ID NO: 947 - DNA, 25 bp, equine
tgtgattaaatgcagcccctggtgc

SEQ ID NO: 948 - DNA, 25 bp, equine
ctctctttccttgtgacgacagaca

SEQ ID NO: 949 - DNA, 25 bp, equine
gacaacatggtttctcttgccagtg

SEQ ID NO: 950 - DNA, 25 bp, equine
gctgtctgggacttggtttgtaaaa

SEQ ID NO: 951 - DNA, 25 bp, equine
agaacaagtgactctgaccagcagg

SEQ ID NO: 952 - DNA, 25 bp, equine
gaccagcaggtttaccttgttgaaa

SEQ ID NO: 953 - DNA, 25 bp, equine
aatattccaattcattcttgcccca

SEQ ID NO: 954 - DNA, 25 bp, equine
gtggagaagttctgcccgacataga

SEQ ID NO: 955 - DNA, 25 bp, equine
gcccgacatagataccttacagatt

SEQ ID NO: 956 - DNA, 25 bp, equine
aagtgtcgatgtttcacttccccaa

SEQ ID NO: 957 - DNA, 25 bp, equine
gtcaagattttcttcctccaagagt

SEQ ID NO: 958 - DNA, 25 bp, equine
ggacattttttgtggacttccataa

SEQ ID NO: 959 - DNA, 25 bp, equine
agaatccgtaacataccagtctcct

SEQ ID NO: 960 - DNA, 25 bp, equine
aacgttcagtttatgtgagcacgaa

SEQ ID NO: 961 - DNA, 25 bp, equine
atggaagaagcctcgctgagagatt

SEQ ID NO: 962 - DNA, 25 bp, equine
tggtcatcatcgcagtgggtgcctt

SEQ ID NO: 963 - DNA, 25 bp, equine
agtgggtgccttcctcttcctggtg

SEQ ID NO: 964 - DNA, 25 bp, equine
ttcctggtggcctttgtgggctgct

SEQ ID NO: 965 - DNA, 25 bp, equine
gggcctgcaaggagaactactgtct

SEQ ID NO: 966 - DNA, 25 bp, equine
ggagaactactgtcttatgatcacg

SEQ ID NO: 967 - DNA, 25 bp, equine
actgtcttatgatcacgtttgccgt

SEQ ID NO: 968 - DNA, 25 bp, equine
atgatcacgtttgccgtcttcctgt

SEQ ID NO: 969 - DNA, 25 bp, equine
ttcctgtctcttatcacgctggtgg

SEQ ID NO: 970 - DNA, 25 bp, equine
tcttatcacgctggtggaggtggcc

SEQ ID NO: 971 - DNA, 25 bp, equine
gtggccgcagccatagctggctatg

SEQ ID NO: 972 - DNA, 25 bp, equine
catagctggctatgtctttagagac

SEQ ID NO: 973 - DNA, 25 bp, equine
tgttacccgagtctgacccagtcct

SEQ ID NO: 974 - DNA, 25 bp, equine
agtcctgggttagctgccgccatat

SEQ ID NO: 975 - DNA, 25 bp, equine
gctgccgccatatcactggattgga

SEQ ID NO: 976 - DNA, 25 bp, equine
atcactggattggatgctgagccta

SEQ ID NO: 977 - DNA, 25 bp, equine
gatgctgagcctagaaactgatcaa

SEQ ID NO: 978 - DNA, 25 bp, equine
gaatgacttaggaggccccaggaaa

SEQ ID NO: 979 - DNA, 25 bp, equine
aggatttgcctagagaggcccgttc

SEQ ID NO: 980 - DNA, 25 bp, equine
gttccttcaacagagcttcatctag

SEQ ID NO: 981 - DNA, 25 bp, equine
agagcttcatctagctggcaccaga

SEQ ID NO: 982 - DNA, 25 bp, equine
tggcaccagaggcaggattgcacct

SEQ ID NO: 983 - DNA, 25 bp, equine
ttgcacctgtggtgggtgcttagcc

SEQ ID NO: 984 - DNA, 25 bp, equine
gaaattgtgattagccggtagtgac

SEQ ID NO: 985 - DNA, 25 bp, equine
agtgacagtttgctgtcaggtcccc

SEQ ID NO: 986 - DNA, 25 bp, equine
tgggcctcctcttaggcatgggatc

SEQ ID NO: 987 - DNA, 25 bp, equine
atgggatccccagagtggacctgcc

SEQ ID NO: 988 - DNA, 25 bp, equine
gccagtttgtgcacccatggagagc

SEQ ID NO: 989 - DNA, 25 bp, equine
atggagagcgttgctggcagccata

SEQ ID NO: 990 - DNA, 25 bp, equine
agggagtgggtcacagcccatgacc

SEQ ID NO: 991 - DNA, 25 bp, equine
ggcattccagacagctgacccggca

SEQ ID NO: 992 - DNA, 25 bp, equine
acgttttgcctgcacatggctcaga

SEQ ID NO: 993 - DNA, 25 bp, equine
agaccttgggtcgagtaacgcttgt

SEQ ID NO: 994 - DNA, 25 bp, equine
gagtaacgcttgtttgtgtgtatct

SEQ ID NO: 995 - DNA, 25 bp, equine
tcattgattccgtgtgtcacagcat

SEQ ID NO: 996 - DNA, 25 bp, equine
attttctgaagaaccgcctcacgag

SEQ ID NO: 997 - DNA, 25 bp, equine
acgagactcattgttctgcgtgtcc

SEQ ID NO: 998 - DNA, 25 bp, equine
gttctgaaattgtcacgctctgtag

SEQ ID NO: 999 - DNA, 25 bp, equine
gaggacacggtttgttctctgtgca

SEQ ID NO: 1000 - DNA, 25 bp, equine
aagggagccctgcacctcagaagga

SEQ ID NO: 1001 - DNA, 25 bp, equine
attcccttgccagtgactagttcta

SEQ ID NO: 1002 - DNA, 25 bp, equine
tgagacccaattcaggccgataaga

SEQ ID NO: 1003 - DNA, 25 bp, equine
tctgggcacgcttgagtctgaatgt

SEQ ID NO: 1004 - DNA, 25 bp, equine
taccagcccgatgttgaacgcgaca

SEQ ID NO: 1005 - DNA, 25 bp, equine
gatggaacacacctaagccctgagt

SEQ ID NO: 1006 - DNA, 25 bp, equine
aggagcgaatctgcagggtcttctc

SEQ ID NO: 1007 - DNA, 25 bp, equine
ctgagctttgaggactttctggacc

SEQ ID NO: 1008 - DNA, 25 bp, equine
gacctcctcagtgtgttcagtgaca

SEQ ID NO: 1009 - DNA, 25 bp, equine
atgccttccgcatctttgactttga

SEQ ID NO: 1010 - DNA, 25 bp, equine
gagatgacctgagccagctcgtgaa

SEQ ID NO: 1011 - DNA, 25 bp, equine
cacggctcagtgcttccgagatgaa

SEQ ID NO: 1012 - DNA, 25 bp, equine
ggatgggaccatcaatctctctgag

SEQ ID NO: 1013 - DNA, 25 bp, equine
aatctctctgagttccagcatgtca

SEQ ID NO: 1014 - DNA, 25 bp, equine
accagactttgcaagctcctttaag

SEQ ID NO: 1015 - DNA, 25 bp, equine
gctcctttaagattgtcctgtgaca

SEQ ID NO: 1016 - DNA, 25 bp, equine
gaccaaggtcatgcctgtgttgcca

SEQ ID NO: 1017 - DNA, 25 bp, equine
gagcggcacgagtctcagacctgaa

SEQ ID NO: 1018 - DNA, 25 bp, equine
gcatggaccggatagactcttgact

SEQ ID NO: 1019 - DNA, 25 bp, equine
ttctgcccacagtttgtgatctgca

SEQ ID NO: 1020 - DNA, 25 bp, equine
tgcagagtccagctagggtaaccct

SEQ ID NO: 1021 - DNA, 25 bp, equine
gagccaaagttttctcattctccct

SEQ ID NO: 1022 - DNA, 25 bp, equine
aaattctctctccatcttttcggtg

SEQ ID NO: 1023 - DNA, 25 bp, equine
ttttcggtgcattggccatgttact

SEQ ID NO: 1024 - DNA, 25 bp, equine
gccatgttactgtgccaatagtgtc

SEQ ID NO: 1025 - DNA, 25 bp, equine
taattcttgttccatctgttctcag

SEQ ID NO: 1026 - DNA, 25 bp, equine
gccttgaaccccacataggagttgt

SEQ ID NO: 1027 - DNA, 25 bp, equine
gttactccttgtagttgatcctgat

SEQ ID NO: 1028 - DNA, 25 bp, equine
tgaagcccaatatggtaaccccagg

SEQ ID NO: 1029 - DNA, 25 bp, equine
gattgccatggcaactgtcacggca

SEQ ID NO: 1030 - DNA, 25 bp, equine
tgggatcaccttcctatctggaggc

SEQ ID NO: 1031 - DNA, 25 bp, equine
aggaggaggcatccatcaacctcaa

SEQ ID NO: 1032 - DNA, 25 bp, equine
ggaatatgtcaagcgagccctggcc

SEQ ID NO: 1033 - DNA, 25 bp, equine
aaatacaccccaagtggtcacgctg

SEQ ID NO: 1034 - DNA, 25 bp, equine
ttcatctctaaccatgcctactaag

SEQ ID NO: 1035 - DNA, 25 bp, equine
agtggaggtattctaaggctgcccc

SEQ ID NO: 1036 - DNA, 25 bp, equine
agggctttaggctgttctttcccat

SEQ ID NO: 1037 - DNA, 25 bp, equine
ttgcctccctggtgacattggtctg

SEQ ID NO: 1038 - DNA, 25 bp, equine
gtctgtggtattgtctgtgtatgct

SEQ ID NO: 1039 - DNA, 25 bp, equine
ttcatcatgctcatcatactcgtac

SEQ ID NO: 1040 - DNA, 25 bp, equine
ttgccccttcgaagaaatcacgtca

SEQ ID NO: 1041 - DNA, 25 bp, equine
ggcactcacacttgggcagcatgta

SEQ ID NO: 1042 - DNA, 25 bp, equine
atacatgtatctatctgtcccttca

SEQ ID NO: 1043 - DNA, 25 bp, equine
gtgtttttgtagacttctgacccag

SEQ ID NO: 1044 - DNA, 25 bp, equine
aagaacgtaccattgactcagctcc

SEQ ID NO: 1045 - DNA, 25 bp, equine
tgttggtactcccagcaatgtctag

SEQ ID NO: 1046 - DNA, 25 bp, equine
caatgtctagctgtgtgaccttagg

SEQ ID NO: 1047 - DNA, 25 bp, equine
ttcttctatgagatggcggccacga

SEQ ID NO: 1048 - DNA, 25 bp, equine
aaaggatgtgtagcagacccctgcc

SEQ ID NO: 1049 - DNA, 25 bp, equine
tggcaggtactcagttgatcgtcga

SEQ ID NO: 1050 - DNA, 25 bp, equine
ccgactccagcagcacgtagaagtg

SEQ ID NO: 1051 - DNA, 25 bp, equine
agactttcccaggttcgggagctgc

SEQ ID NO: 1052 - DNA, 25 bp, equine
gctgctgtgtccagaggtggcattt

SEQ ID NO: 1053 - DNA, 25 bp, equine
ggcatttgactatttttgaccagga

SEQ ID NO: 1054 - DNA, 25 bp, equine
gtaagcgcgaggaaatcctttttat

SEQ ID NO: 1055 - DNA, 25 bp, equine
ttttattgtattatcttccctccct

SEQ ID NO: 1056 - DNA, 25 bp, equine
ggctgctgggtctgttgtcagtcct

SEQ ID NO: 1057 - DNA, 25 bp, equine
tgtcagtcctgctgctaacctggca

SEQ ID NO: 1058 - DNA, 25 bp, equine
gccgtgagctgccatgtgcttctca

SEQ ID NO: 1059 - DNA, 25 bp, equine
ctcagagctgcccaagtggaggctc

SEQ ID NO: 1060 - DNA, 25 bp, equine
aagtggaggctctagctgactgcct

SEQ ID NO: 1061 - DNA, 25 bp, equine
gagaaactccattctaccactatga

SEQ ID NO: 1062 - DNA, 25 bp, equine
gtgttcctttcgttttgggtatcat

SEQ ID NO: 1063 - DNA, 25 bp, equine
gttttgggtatcatcttcctgactc

SEQ ID NO: 1064 - DNA, 25 bp, equine
atcatcttcctgactctgattggag

SEQ ID NO: 1065 - DNA, 25 bp, equine
gagttcaaggagctccagtaatgag

SEQ ID NO: 1066 - DNA, 25 bp, equine
aagggacgctgttcctgcatcaaga

SEQ ID NO: 1067 - DNA, 25 bp, equine
gcatcaagaccagccaagggacgat

SEQ ID NO: 1068 - DNA, 25 bp, equine
gacgatccgcccaaaactgttaaag

SEQ ID NO: 1069 - DNA, 25 bp, equine
ttaaacagtttgctccaagcccttc

SEQ ID NO: 1070 - DNA, 25 bp, equine
caagcccttcttgtgagacaactga

SEQ ID NO: 1071 - DNA, 25 bp, equine
gtctaaacccagattcagcagaagt

SEQ ID NO: 1072 - DNA, 25 bp, equine
gggacagcctgcttggccattgcaa

SEQ ID NO: 1073 - DNA, 25 bp, equine
ctgcttggccattgcaagcggcatt

SEQ ID NO: 1074 - DNA, 25 bp, equine
attgcaagcggcatttacctgctgg

SEQ ID NO: 1075 - DNA, 25 bp, equine
aagcggcatttacctgctggcggcc

SEQ ID NO: 1076 - DNA, 25 bp, equine
ccgtccgtggtgagcagtggacccc

SEQ ID NO: 1077 - DNA, 25 bp, equine
ccccagccgaggtttgcaagaagct

SEQ ID NO: 1078 - DNA, 25 bp, equine
aggtttgcaagaagctcagcgagga

SEQ ID NO: 1079 - DNA, 25 bp, equine
agcgaggaggagtccgcggccgcca

SEQ ID NO: 1080 - DNA, 25 bp, equine
atcccggtgaccgatgaggttgtgt

SEQ ID NO: 1081 - DNA, 25 bp, equine
gtgacggtgtgtgaccagagcctca

SEQ ID NO: 1082 - DNA, 25 bp, equine
tgtgtgaccagagcctcaaaccgct

SEQ ID NO: 1083 - DNA, 25 bp, equine
aggccctacggctatgcctggcagg

SEQ ID NO: 1084 - DNA, 25 bp, equine
agatctgcaaggtggcagtggccac

SEQ ID NO: 1085 - DNA, 25 bp, equine
ggcagtggccactctgagccatgag

SEQ ID NO: 1086 - DNA, 25 bp, equine
tgagccatgagcagatgattgatct

SEQ ID NO: 1087 - DNA, 25 bp, equine
gattgatctgctgagaacatccgtc

SEQ ID NO: 1088 - DNA, 25 bp, equine
ctgctgagaacatccgtcacggtga

SEQ ID NO: 1089 - DNA, 25 bp, equine
cacggtgaaggtggtcattatcccc

SEQ ID NO: 1090 - DNA, 25 bp, equine
atgatgactgcaccccacggaggag

SEQ ID NO: 1091 - DNA, 25 bp, equine
accccacggaggagttgctctgaaa

SEQ ID NO: 1092 - DNA, 25 bp, equine
aggagttgctctgaaacctaccgca

SEQ ID NO: 1093 - DNA, 25 bp, equine
aacctaccgcatgccagtgatggaa

SEQ ID NO: 1094 - DNA, 25 bp, equine
gattccttccagctgagaggattag

SEQ ID NO: 1095 - DNA, 25 bp, equine
aatggaagggttgggagcactttct

SEQ ID NO: 1096 - DNA, 25 bp, equine
gggcatactcctgaagccagttttg

SEQ ID NO: 1097 - DNA, 25 bp, equine
gttttgaaaagctcaatggcaccag

SEQ ID NO: 1098 - DNA, 25 bp, equine
aatggcaccagaaaagcagtaagac

SEQ ID NO: 1099 - DNA, 25 bp, equine
ctgggctagatcagagaggtctctc

SEQ ID NO: 1100 - DNA, 25 bp, equine
atcagagaggtctctcgggctgtgc

SEQ ID NO: 1101 - DNA, 25 bp, equine
aacagcgggctctgagttgtgtctt

SEQ ID NO: 1102 - DNA, 25 bp, equine
gcgggctctgagttgtgtcttagaa

SEQ ID NO: 1103 - DNA, 25 bp, equine
agaagagtctctttggcgtggtcca

SEQ ID NO: 1104 - DNA, 25 bp, equine
ttggcgtggtccacaggacagagtt

SEQ ID NO: 1105 - DNA, 25 bp, equine
attgttgatgagctgtttccgcgtc

SEQ ID NO: 1106 - DNA, 25 bp, equine
gatcaacaagctccatctgtgcaaa

SEQ ID NO: 1107 - DNA, 25 bp, equine
gagagacgattacagcaccgcgcag

SEQ ID NO: 1108 - DNA, 25 bp, equine
aagcggaggagtacctgtccttcgc

SEQ ID NO: 1109 - DNA, 25 bp, equine
gatgattctgatatacctgcttcca

SEQ ID NO: 1110 - DNA, 25 bp, equine
aaatgctgctgggtcatatgccaac

SEQ ID NO: 1111 - DNA, 25 bp, equine
atatgccaaccattgagctcttgaa

SEQ ID NO: 1112 - DNA, 25 bp, equine
agtaccatctcatgcagtttgctga

SEQ ID NO: 1113 - DNA, 25 bp, equine
tgtaagcgaaggcaatctcctcctg

SEQ ID NO: 1114 - DNA, 25 bp, equine
gaacgaggctctcacaaagcacgag

SEQ ID NO: 1115 - DNA, 25 bp, equine
aaagcacgagaccttcttcattcgc

SEQ ID NO: 1116 - DNA, 25 bp, equine
ggctagaggatgaccgtgcgtggca

SEQ ID NO: 1117 - DNA, 25 bp, equine
agggcgccgccgacggaggcatgat

SEQ ID NO: 1118 - DNA, 25 bp, equine
gaggcatgatggacagggaccacaa

SEQ ID NO: 1119 - DNA, 25 bp, equine
agaagtatgtctggtcactcgggcc

SEQ ID NO: 1120 - DNA, 25 bp, equine
gccacatgatgacccgcggcgggat

SEQ ID NO: 1121 - DNA, 25 bp, equine
atgcagggcggcttcggaggccaga

SEQ ID NO: 1122 - DNA, 25 bp, equine
ttaggagccccttcaactgtgtaca

SEQ ID NO: 1123 - DNA, 25 bp, equine
gccccttcaactgtgtacaatacgt

SEQ ID NO: 1124 - DNA, 25 bp, equine
ttttttatctgctgccatattgtag

SEQ ID NO: 1125 - DNA, 25 bp, equine
atctgctgccatattgtagctcaat

SEQ ID NO: 1126 - DNA, 25 bp, equine
gtagctcaatacaatgtgaatttgt

SEQ ID NO: 1127 - DNA, 25 bp, equine
ggacaagcgtgtcaacgacctgttc

SEQ ID NO: 1128 - DNA, 25 bp, equine
gtgtcaacgacctgttccgcatcat

SEQ ID NO: 1129 - DNA, 25 bp, equine
atcatccccggcattgggaacttcg

SEQ ID NO: 1130 - DNA, 25 bp, equine
gcattgggaacttcggtgaccgtta

SEQ ID NO: 1131 - DNA, 25 bp, equine
gtgaccgttactttgggaccgatgc

SEQ ID NO: 1132 - DNA, 25 bp, equine
gaccgatgctgtccctgatggcagt

SEQ ID NO: 1133 - DNA, 25 bp, equine
atgctgtccctgatggcagtgacga

SEQ ID NO: 1134 - DNA, 25 bp, equine
aagtggcttccacgagttagctgtg

SEQ ID NO: 1135 - DNA, 25 bp, equine
agttagctgtgcaggctgagccacc

SEQ ID NO: 1136 - DNA, 25 bp, equine
ttggctcttgctttccgagtacaga

SEQ ID NO: 1137 - DNA, 25 bp, equine
cttgctttccgagtacagagatgtt

SEQ ID NO: 1138 - DNA, 25 bp, equine
accggtgggtctttagcatctgcag

SEQ ID NO: 1139 - DNA, 25 bp, equine
taggtggtccgtgtctcatccaaga

SEQ ID NO: 1140 - DNA, 25 bp, equine
tccaagactgatgaggcctgctgca

SEQ ID NO: 1141 - DNA, 25 bp, equine
aagctgacatcatcggccacaggga

SEQ ID NO: 1142 - DNA, 25 bp, equine
aagagcgcgtcatagtcccggagga

SEQ ID NO: 1143 - DNA, 25 bp, equine
ggaacctcttctcctgaagcaagga

SEQ ID NO: 1144 - DNA, 25 bp, equine
ggaactcttcgatgaagccctgaat

SEQ ID NO: 1145 - DNA, 25 bp, equine
gaatgttgtcacagctgctttccaa

SEQ ID NO: 1146 - DNA, 25 bp, equine
gaatgggagagcctctgccacaagt

SEQ ID NO: 1147 - DNA, 25 bp, equine
aagcctcctcttcttaattgcagac

SEQ ID NO: 1148 - DNA, 25 bp, equine
aattgcagactccagttcgggaact

SEQ ID NO: 1149 - DNA, 25 bp, equine
tacagcccctggaccttttgaagga

SEQ ID NO: 1150 - DNA, 25 bp, equine
gagtctggctcccaggctgaagaaa

SEQ ID NO: 1151 - DNA, 25 bp, equine
tatactcggccacagctaaagcttt

SEQ ID NO: 1152 - DNA, 25 bp, equine
tttcacttttctccttcggaagcaa

SEQ ID NO: 1153 - DNA, 25 bp, equine
gcaaaactggcctgtacgagatccc

SEQ ID NO: 1154 - DNA, 25 bp, equine
gatcccctgttaaaacttctcggcg

SEQ ID NO: 1155 - DNA, 25 bp, equine
aattgttgtatttctctctgcttcc

SEQ ID NO: 1156 - DNA, 25 bp, equine
taacagctttgtgatgttcccgctt

SEQ ID NO: 1157 - DNA, 25 bp, equine
tttctttcttcctaacagccagatt

SEQ ID NO: 1158 - DNA, 25 bp, equine
cagccagattgcttttcccataaag

SEQ ID NO: 1159 - DNA, 25 bp, equine
ttgagaatctcaagccatgtgcatt

SEQ ID NO: 1160 - DNA, 25 bp, equine
aatgctttgcaagtcctgtgccaaa

SEQ ID NO: 1161 - DNA, 25 bp, equine
aaagctggcctgaggaccacttgca

SEQ ID NO: 1162 - DNA, 25 bp, equine
taggcacagcagcagtagctccttt

SEQ ID NO: 1163 - DNA, 25 bp, equine
ttccattatctccttcaactcagaa

SEQ ID NO: 1164 - DNA, 25 bp, equine
agaaagggtttctgtctccagccac

SEQ ID NO: 1165 - DNA, 25 bp, equine
ggcgagaccccttgattggcaaaga

SEQ ID NO: 1166 - DNA, 25 bp, equine
agacccgacatgttttaggccctca

SEQ ID NO: 1167 - DNA, 25 bp, equine
gccctcaccagtgttgtcttaggta

SEQ ID NO: 1168 - DNA, 25 bp, equine
gtcttaggtatcaactgctgctctg

SEQ ID NO: 1169 - DNA, 25 bp, equine
agccagcctatttttcagtgcacat

SEQ ID NO: 1170 - DNA, 25 bp, equine
caaggtgctatctgctctggaagtt

SEQ ID NO: 1171 - DNA, 25 bp, equine
atttcctgtggtgttcattttgagc

SEQ ID NO: 1172 - DNA, 25 bp, equine
tagcaaaccttctatgctctcagtg

SEQ ID NO: 1173 - DNA, 25 bp, equine
tcagtgcttcccagagaacatcagg

SEQ ID NO: 1174 - DNA, 25 bp, equine
agattctcacgtgcctttgggatcg

SEQ ID NO: 1175 - DNA, 25 bp, equine
gaagggttcaacaacacgaggtctt

SEQ ID NO: 1176 - DNA, 25 bp, equine
acgaggtcttgatctggacttcaga

SEQ ID NO: 1177 - DNA, 25 bp, equine
gaatcaatggtgctgtgctgtcaat

SEQ ID NO: 1178 - DNA, 25 bp, equine
tgctgtcaatggctactcggtggaa

SEQ ID NO: 1179 - DNA, 25 bp, equine
aagggttgccccagaataaatctct

SEQ ID NO: 1180 - DNA, 25 bp, equine
aaatctctggattaactctcccggg

SEQ ID NO: 1181 - DNA, 25 bp, equine
gcagggtgccgtttcggtaccaaga

SEQ ID NO: 1182 - DNA, 25 bp, equine
gacacaaactttcagaccatagcaa

SEQ ID NO: 1183 - DNA, 25 bp, equine
tgtatgacaaggactgccaggccca

SEQ ID NO: 1184 - DNA, 25 bp, equine
aggcccatccattaacgctagttgg

SEQ ID NO: 1185 - DNA, 25 bp, equine
ttaacgctagttgggttcactcctc

SEQ ID NO: 1186 - DNA, 25 bp, equine
atctcaaatttcctcgatttcacca

SEQ ID NO: 1187 - DNA, 25 bp, equine
gatttcaccaagagcctattgcctt

SEQ ID NO: 1188 - DNA, 25 bp, equine
gagcctattgccttcaagtttttat

SEQ ID NO: 1189 - DNA, 25 bp, equine
aaatgtctggattttcagcttctgt

SEQ ID NO: 1190 - DNA, 25 bp, equine
gtgggagtgttctccaaacacggga

SEQ ID NO: 1191 - DNA, 25 bp, equine
tgctggacagcccaactgaatggtg

SEQ ID NO: 1192 - DNA, 25 bp, equine
ggtgatactgaccacacttgccata

SEQ ID NO: 1193 - DNA, 25 bp, equine
tgggttgctgccacaacatggctgc

SEQ ID NO: 1194 - DNA, 25 bp, equine
gagtgatgtgggtccacacccagga

SEQ ID NO: 1195 - DNA, 25 bp, equine
ggagctgaaccctgggctgctgaat

SEQ ID NO: 1196 - DNA, 25 bp, equine
gccagcccctacaagtcatttttta

SEQ ID NO: 1197 - DNA, 25 bp, equine
actttcagtgacataggctgccttt

SEQ ID NO: 1198 - DNA, 25 bp, equine
ggctgccttttctaaactaatcctt

SEQ ID NO: 1199 - DNA, 25 bp, equine
acagagtcttgatttctgcacccca

SEQ ID NO: 1200 - DNA, 25 bp, equine
gcaccccatctttacctttgaggaa

SEQ ID NO: 1201 - DNA, 25 bp, equine
ggccagcccggtgatgtaatgatta

SEQ ID NO: 1202 - DNA, 25 bp, equine
aagtttgcacactccacttcagtgg

SEQ ID NO: 1203 - DNA, 25 bp, equine
agtggcctgggattcaccagttcag

SEQ ID NO: 1204 - DNA, 25 bp, equine
aagagaatgtagttccctcctcagg

SEQ ID NO: 1205 - DNA, 25 bp, equine
caggctttcgtggttagcttaccga

SEQ ID NO: 1206 - DNA, 25 bp, equine
ggtacaagccgagctgccagggaat

SEQ ID NO: 1207 - DNA, 25 bp, equine
acagtcttgctgtccagggaaccaa

SEQ ID NO: 1208 - DNA, 25 bp, equine
gtccgttttcagttctatctccaaa

SEQ ID NO: 1209 - DNA, 25 bp, equine
taacaggcccttggcacagcaagat

SEQ ID NO: 1210 - DNA, 25 bp, equine
agcaagatcctttctgcaggctgat

SEQ ID NO: 1211 - DNA, 25 bp, equine
aaaaacgattctgtctccttcaaag

SEQ ID NO: 1212 - DNA, 25 bp, equine
gagtacttgttttctgacttgtcca

SEQ ID NO: 1213 - DNA, 25 bp, equine
aatgcactatgcttgatcgccgatt

SEQ ID NO: 1214 - DNA, 25 bp, equine
gtataacgtcgttgcctttatttgt

SEQ ID NO: 1215 - DNA, 25 bp, equine
atgagctggaggcacttctaccttt

SEQ ID NO: 1216 - DNA, 25 bp, equine
tacctttgtgggtcccttattctat

SEQ ID NO: 1217 - DNA, 25 bp, equine
gacttctaaaagctcatgggcccta

SEQ ID NO: 1218 - DNA, 25 bp, equine
ggccctgccattacgtggatactgt

SEQ ID NO: 1219 - DNA, 25 bp, equine
ggatactgtgcctttagctgtaaca

SEQ ID NO: 1220 - DNA, 25 bp, equine
taacaccgagcctgtatcctttaat

SEQ ID NO: 1221 - DNA, 25 bp, equine
tgatttcattcaggcatgctcatct

SEQ ID NO: 1222 - DNA, 25 bp, equine
aaatgggacccagctctcttggtga

SEQ ID NO: 1223 - DNA, 25 bp, equine
gtgagccaggatctctttacgttta

SEQ ID NO: 1224 - DNA, 25 bp, equine
tattgttttaactctcttcccaggt

SEQ ID NO: 1225 - DNA, 25 bp, equine
ttcaaacttttctgatcccagccta

SEQ ID NO: 1226 - DNA, 25 bp, equine
gaacctgttggatgaccttgtaact

SEQ ID NO: 1227 - DNA, 25 bp, equine
gagagagactacttctggcatcctt

SEQ ID NO: 1228 - DNA, 25 bp, equine
agaaccagatctcatcaggtccagc

SEQ ID NO: 1229 - DNA, 25 bp, equine
taagcgaggagtacccaacccttgg

SEQ ID NO: 1230 - DNA, 25 bp, equine
gatgaaatccggcagcagcagcaga

SEQ ID NO: 1231 - DNA, 25 bp, equine
tttcctccatcataagtcgccagaa

SEQ ID NO: 1232 - DNA, 25 bp, equine
atgaccttgccaacctggtggagaa

SEQ ID NO: 1233 - DNA, 25 bp, equine
gattttattgctgctcgtggctatt

SEQ ID NO: 1234 - DNA, 25 bp, equine
gtggctattgtggtcgtcgcagtct

SEQ ID NO: 1235 - DNA, 25 bp, equine
tcgcagtctggcctaccaagtagtg

SEQ ID NO: 1236 - DNA, 25 bp, equine
agttcagtgcccttttggtacacga

SEQ ID NO: 1237 - DNA, 25 bp, equine
aggtctccgtctgctttcttttttg

SEQ ID NO: 1238 - DNA, 25 bp, equine
aggctttaggccacaggcagcttct

SEQ ID NO: 1239 - DNA, 25 bp, equine
caaggtggccagatggttccaggac

SEQ ID NO: 1240 - DNA, 25 bp, equine
gttccaggaccacagtgtctttatt

SEQ ID NO: 1241 - DNA, 25 bp, equine
atttttaactgtttgccactgctgc

SEQ ID NO: 1242 - DNA, 25 bp, equine
tggagtactctctgccccagactag

SEQ ID NO: 1243 - DNA, 25 bp, equine
gccccagactagcaggagtgagttc

SEQ ID NO: 1244 - DNA, 25 bp, equine
agcgctgattctccccgcagtgttg

SEQ ID NO: 1245 - DNA, 25 bp, equine
gggcataccttctaactgagcagta

SEQ ID NO: 1246 - DNA, 25 bp, equine
gcacgagcctgggaactgcttttat

SEQ ID NO: 1247 - DNA, 25 bp, equine
aatttatctctgtgacctgctaggg

SEQ ID NO: 1248 - DNA, 25 bp, equine
acgagcggcacgagccgaagatggc

SEQ ID NO: 1249 - DNA, 25 bp, equine
gcggcacgagccgaagatggcggag

SEQ ID NO: 1250 - DNA, 25 bp, equine
gggcaggtcctggtgctggatggcc

SEQ ID NO: 1251 - DNA, 25 bp, equine
caggtcctggtgctggatggccggg

SEQ ID NO: 1252 - DNA, 25 bp, equine
gcctggcggccatcgtggccaagca

SEQ ID NO: 1253 - DNA, 25 bp, equine
gccatcgtggccaagcaggtgctgc

SEQ ID NO: 1254 - DNA, 25 bp, equine
ccatcgtggccaagcaggtgctgct

SEQ ID NO: 1255 - DNA, 25 bp, equine
catcgtggccaagcaggtgctgctg

SEQ ID NO: 1256 - DNA, 25 bp, equine
aagcaggtgctgctgggccggaagg

SEQ ID NO: 1257 - DNA, 25 bp, equine
gctgctgggccggaaggtggtggtc

SEQ ID NO: 1258 - DNA, 25 bp, equine
cttcctccgcaagcctacacgaaag

SEQ ID NO: 1259 - DNA, 25 bp, equine
atctctttcctcattttcctgatag

SEQ ID NO: 1260 - DNA, 25 bp, equine
gatgaggatggccttcctgtttcac

SEQ ID NO: 1261 - DNA, 25 bp, equine
atcttctcaatctttctttaccggg

SEQ ID NO: 1262 - DNA, 25 bp, equine
aatacgcttggcactgatgggcact

SEQ ID NO: 1263 - DNA, 25 bp, equine
cagaccccggatgctatttattcaa

SEQ ID NO: 1264 - DNA, 25 bp, equine
gtttgaatgagtccttcgtgggcca

SEQ ID NO: 1265 - DNA, 25 bp, equine
aggcttatctttttgtctagtgcaa

SEQ ID NO: 1266 - DNA, 25 bp, equine
tttacctaaatacttccagctcctt

SEQ ID NO: 1267 - DNA, 25 bp, equine
aagctcagtacactaatgcctcatc

SEQ ID NO: 1268 - DNA, 25 bp, equine
atgcctcatcttagcagtgattttg

SEQ ID NO: 1269 - DNA, 25 bp, equine
aaacctgactgagttttcctgtcta

SEQ ID NO: 1270 - DNA, 25 bp, equine
gaggcttgaaaacacaccacattga

SEQ ID NO: 1271 - DNA, 25 bp, equine
accacattgaaaatcctgccacagc

SEQ ID NO: 1272 - DNA, 25 bp, equine
taagcactggcttcgtaggaaacca

SEQ ID NO: 1273 - DNA, 25 bp, equine
catacgccggccgtcttggaaaaga

SEQ ID NO: 1274 - DNA, 25 bp, equine
agaactagcttttctgccttttggc

SEQ ID NO: 1275 - DNA, 25 bp, equine
gcctggcctttgctactggtaagaa

SEQ ID NO: 1276 - DNA, 25 bp, equine
aagatggagcctgggtctcaagccc

SEQ ID NO: 1277 - DNA, 25 bp, equine
tgtacctttgccacactgtatgtgt

SEQ ID NO: 1278 - DNA, 25 bp, equine
gaggctgagggattctttccagtct

SEQ ID NO: 1279 - DNA, 25 bp, equine
ggtatccacattctcaacttcaagt

SEQ ID NO: 1280 - DNA, 25 bp, equine
agtcattgcagtttctttttcccag

SEQ ID NO: 1281 - DNA, 25 bp, equine
acgtgttcagggtttggttggctca

SEQ ID NO: 1282 - DNA, 25 bp, equine
ggttggctcaactccaaactcaata

SEQ ID NO: 1283 - DNA, 25 bp, equine
tgattaccaatatgatctcccgtcc

SEQ ID NO: 1284 - DNA, 25 bp, equine
tgatctcccgtccagtagcgtggga

SEQ ID NO: 1285 - DNA, 25 bp, equine
aggtatttcctctgtggtgccatag

SEQ ID NO: 1286 - DNA, 25 bp, equine
ggagcagttccatctcactgtgtaa

SEQ ID NO: 1287 - DNA, 25 bp, equine
acgaattggaaagccgacccgcaag

SEQ ID NO: 1288 - DNA, 25 bp, equine
gacccgcaagggagcttgtctattg

SEQ ID NO: 1289 - DNA, 25 bp, equine
aaggaacctttgatagccgctgtat

SEQ ID NO: 1290 - DNA, 25 bp, equine
tttgatagccgctgtatctgctcag

SEQ ID NO: 1291 - DNA, 25 bp, equine
tatctgctcagccatgtccacattt

SEQ ID NO: 1292 - DNA, 25 bp, equine
gtgccggctcattcagccagaaaat

SEQ ID NO: 1293 - DNA, 25 bp, equine
cagaaaataaatctcccacccgtgt

SEQ ID NO: 1294 - DNA, 25 bp, equine
tcccacccgtgtttgactttgaaga

SEQ ID NO: 1295 - DNA, 25 bp, equine
actttgaagactccaccaggtcgtg

SEQ ID NO: 1296 - DNA, 25 bp, equine
gagagcttgggaactgcgataactt

SEQ ID NO: 1297 - DNA, 25 bp, equine
gcgataactttctgggagctttggt

SEQ ID NO: 1298 - DNA, 25 bp, equine
tctccgtacacgcatgacacatgtt

SEQ ID NO: 1299 - DNA, 25 bp, equine
catgttcgccatattacgttttatc

SEQ ID NO: 1300 - DNA, 25 bp, equine
tataacaaacacacaccctacattt

SEQ ID NO: 1301 - DNA, 25 bp, equine
ttcacatggttcttaggccacatcc

SEQ ID NO: 1302 - DNA, 25 bp, equine
ggccacatccctctttataaaaatt

SEQ ID NO: 1303 - DNA, 25 bp, equine
gggcctgttaggtcatctgtttcag

SEQ ID NO: 1304 - DNA, 25 bp, equine
gtttcagcatttgtcaacttcttga

SEQ ID NO: 1305 - DNA, 25 bp, equine
ggaaaatcttcaatggcttcaacca

SEQ ID NO: 1306 - DNA, 25 bp, equine
accaagtcttggcagcactgtgcaa

SEQ ID NO: 1307 - DNA, 25 bp, equine
tagactcatttttcaggctagcctg

SEQ ID NO: 1308 - DNA, 25 bp, equine
gcgccgaaacgtctgcatcaaggtg

SEQ ID NO: 1309 - DNA, 25 bp, equine
attcggcacgagtaggattgtcaca

SEQ ID NO: 1310 - DNA, 25 bp, equine
agtggtatcttactctggcagttac

SEQ ID NO: 1311 - DNA, 25 bp, equine
tggcagttaccagactaccttaaaa

SEQ ID NO: 1312 - DNA, 25 bp, equine
gtgagccttctgtgtatgatctgtc

SEQ ID NO: 1313 - DNA, 25 bp, equine
atgatctgtctgttcctgtttcaaa

SEQ ID NO: 1314 - DNA, 25 bp, equine
aattttctcctagtctgtagctttt

SEQ ID NO: 1315 - DNA, 25 bp, equine
tgtagcttttcttttcacgtgttaa

SEQ ID NO: 1316 - DNA, 25 bp, equine
gaagcccgatttatccatttgttct

SEQ ID NO: 1317 - DNA, 25 bp, equine
gacatgcccttggtgtggtatctaa

SEQ ID NO: 1318 - DNA, 25 bp, equine
ggatatccatttattctagcaccat

SEQ ID NO: 1319 - DNA, 25 bp, equine
aaggctgtttattctccattgcatt

SEQ ID NO: 1320 - DNA, 25 bp, equine
cattgcctttgcacctttgtacaaa

SEQ ID NO: 1321 - DNA, 25 bp, equine
gtaggcttatttctggactctgttc

SEQ ID NO: 1322 - DNA, 25 bp, equine
gttctgttccttttctctgtttata

SEQ ID NO: 1323 - DNA, 25 bp, equine
agacaggtagtgttagccctccaac

SEQ ID NO: 1324 - DNA, 25 bp, equine
tggctattctaggtcatttgcattt

SEQ ID NO: 1325 - DNA, 25 bp, equine
agcaactggcacaagggctgggact

SEQ ID NO: 1326 - DNA, 25 bp, equine
gggactggacctcagggtctaacaa

SEQ ID NO: 1327 - DNA, 25 bp, equine
taacaagtgtccagctgaggccacc

SEQ ID NO: 1328 - DNA, 25 bp, equine
ctgccgcacatttgagtcctacttc

SEQ ID NO: 1329 - DNA, 25 bp, equine
gctgccctgtgtgaggaactctgga

SEQ ID NO: 1330 - DNA, 25 bp, equine
ggagtcactcctacaaggtcagcaa

SEQ ID NO: 1331 - DNA, 25 bp, equine
aggtcagcaactaccgccgagggag

SEQ ID NO: 1332 - DNA, 25 bp, equine
tgcatccagatgtggttcgacccgg

SEQ ID NO: 1333 - DNA, 25 bp, equine
gaggttctatgccttggccatgact

SEQ ID NO: 1334 - DNA, 25 bp, equine
agctttgatgaccaggctaggctca

SEQ ID NO: 1335 - DNA, 25 bp, equine
taggctcagctcagctcctaagcat

SEQ ID NO: 1336 - DNA, 25 bp, equine
aaccacaacgtgaatttgcaacagg

SEQ ID NO: 1337 - DNA, 25 bp, equine
gaaccaaaacttctaaggccctgct

SEQ ID NO: 1338 - DNA, 25 bp, equine
gggtcagccatttttaatgatctcg

SEQ ID NO: 1339 - DNA, 25 bp, equine
tgatctcggatgaccaaaccagcct

SEQ ID NO: 1340 - DNA, 25 bp, equine
atgaccaaaccagccttcggagcgt

SEQ ID NO: 1341 - DNA, 25 bp, equine
tctgtcctacttctgactttacttg

SEQ ID NO: 1342 - DNA, 25 bp, equine
ctgactttacttgtggtgtgaccat

SEQ ID NO: 1343 - DNA, 25 bp, equine
gtgtgaccatgttcattataatctc

SEQ ID NO: 1344 - DNA, 25 bp, equine
caatcttattccgagcattccagta

SEQ ID NO: 1345 - DNA, 25 bp, equine
gagcattccagtaacttttttgtgt

SEQ ID NO: 1346 - DNA, 25 bp, equine
tttggcctgtttgatgtatgtgtga

SEQ ID NO: 1347 - DNA, 25 bp, equine
gtctggcccggttcaaaagcaacgt

SEQ ID NO: 1348 - DNA, 25 bp, equine
agggttttgagtacatcttggccaa

SEQ ID NO: 1349 - DNA, 25 bp, equine
taaaagtcaacttccagtcctctct

SEQ ID NO: 1350 - DNA, 25 bp, equine
ttttgggcatctacggtgcaccagg

SEQ ID NO: 1351 - DNA, 25 bp, equine
gttaccaacatctgagccgagtctg

SEQ ID NO: 1352 - DNA, 25 bp, equine
gagtctgcttattctcacattgggc

SEQ ID NO: 1353 - DNA, 25 bp, equine
aggtgcagtgacttgcccagggtca

SEQ ID NO: 1354 - DNA, 25 bp, equine
acagcgtgcgggtgacatggtcata

SEQ ID NO: 1355 - DNA, 25 bp, equine
taaatgctagactgtacgctccacg

SEQ ID NO: 1356 - DNA, 25 bp, equine
agggcaggacctgtgttttgttgtc

SEQ ID NO: 1357 - DNA, 25 bp, equine
ttgttgtccgatgtgtcccaggtac

SEQ ID NO: 1358 - DNA, 25 bp, equine
gaagtggagtctttgcctttcccaa

SEQ ID NO: 1359 - DNA, 25 bp, equine
agactttcaacagctcccaagatgt

SEQ ID NO: 1360 - DNA, 25 bp, equine
aagatgtttcccacttacacactgg

SEQ ID NO: 1361 - DNA, 25 bp, equine
atcaccttccacctaggcagagaag

SEQ ID NO: 1362 - DNA, 25 bp, equine
gaagggcaactcctaacaaccggtg

SEQ ID NO: 1363 - DNA, 25 bp, equine
acaaccggtgcactgtgtaaacact

SEQ ID NO: 1364 - DNA, 25 bp, equine
tggtgcaacagctagttccgtgcct

SEQ ID NO: 1365 - DNA, 25 bp, equine
aatgggtacccatagccactggtgg

SEQ ID NO: 1366 - DNA, 25 bp, equine
agagcatacgtcacaccaggaactg

SEQ ID NO: 1367 - DNA, 25 bp, equine
aagcatatttcctccagttggtttc

SEQ ID NO: 1368 - DNA, 25 bp, equine
ggcagtaccacatcacatgctatac

SEQ ID NO: 1369 - DNA, 25 bp, equine
gagtcacccaaggaacttatgcaga

SEQ ID NO: 1370 - DNA, 25 bp, equine
ttatgcagatgccatgtcctcactc

SEQ ID NO: 1371 - DNA, 25 bp, equine
ggagccaggtgtctgcatttgaaca

SEQ ID NO: 1372 - DNA, 25 bp, equine
gtcctgtggcttttgtgtgtctctc

SEQ ID NO: 1373 - DNA, 25 bp, equine
accacttcatgttctctacagagct

SEQ ID NO: 1374 - DNA, 25 bp, equine
ggccttgcttgagagaggtccatcc

SEQ ID NO: 1375 - DNA, 25 bp, equine
ggtcacttagcagcgacttcttgga

SEQ ID NO: 1376 - DNA, 25 bp, equine
acagagctgtccagagccgaggctg

SEQ ID NO: 1377 - DNA, 25 bp, equine
cgttgcccgctgttggtcatgacaa

SEQ ID NO: 1378 - DNA, 25 bp, equine
aaacgagtccgagggcacagccagg

SEQ ID NO: 1379 - DNA, 25 bp, equine
gagtctctgtcaggatccttttgaa

SEQ ID NO: 1380 - DNA, 25 bp, equine
ctcgtgccgtgtgctgagaggccct

SEQ ID NO: 1381 - DNA, 25 bp, equine
aggcacagcccctggaatcctgagc

SEQ ID NO: 1382 - DNA, 25 bp, equine
ggaatcctgagctgccatgggctac

SEQ ID NO: 1383 - DNA, 25 bp, equine
atgggctaccccaagacgtccagag

SEQ ID NO: 1384 - DNA, 25 bp, equine
gctaccccaagacgtccagagaaga

SEQ ID NO: 1385 - DNA, 25 bp, equine
gacaatgaacgttggaagatccgat

SEQ ID NO: 1386 - DNA, 25 bp, equine
ttggaagatccgatttcacagcact

SEQ ID NO: 1387 - DNA, 25 bp, equine
gaacaggtgtgtcagtgtgctccca

SEQ ID NO: 1388 - DNA, 25 bp, equine
cacgatgacgatgaggaggaagaac

SEQ ID NO: 1389 - DNA, 25 bp, equine
ggaagaacgtgccacctcaggtcga

SEQ ID NO: 1390 - DNA, 25 bp, equine
acgtgccacctcaggtcgatttagg

SEQ ID NO: 1391 - DNA, 25 bp, equine
gaggctgccagcacagggtgatcac

SEQ ID NO: 1392 - DNA, 25 bp, equine
atcacagcccaagcagtggaggcct

SEQ ID NO: 1393 - DNA, 25 bp, equine
gacagatacctgtgaacccatcagc

SEQ ID NO: 1394 - DNA, 25 bp, equine
cggtcttcggcagcggctttttcag

SEQ ID NO: 1395 - DNA, 25 bp, equine
gctttttcagccgagtgaggactct

SEQ ID NO: 1396 - DNA, 25 bp, equine
gaggactctgggtcccacgcagaga

SEQ ID NO: 1397 - DNA, 25 bp, equine
aagaccgtggcctcctgggaaggca

SEQ ID NO: 1398 - DNA, 25 bp, equine
atctaagttccagagcagttgacct

SEQ ID NO: 1399 - DNA, 25 bp, equine
gcagttgacctgatgggacgctctc

SEQ ID NO: 1400 - DNA, 25 bp, equine
tttggtcttaagtggatctcgggca

SEQ ID NO: 1401 - DNA, 25 bp, equine
ctggcgtttgactacgagcaggaac

SEQ ID NO: 1402 - DNA, 25 bp, equine
gaaagcacagactctatatccctca

SEQ ID NO: 1403 - DNA, 25 bp, equine
tatatccctcatcgcatggatcgta

SEQ ID NO: 1404 - DNA, 25 bp, equine
tgagcaaagcggacctcagccggaa

SEQ ID NO: 1405 - DNA, 25 bp, equine
agcttgtgcagctcctgaatgggcg

SEQ ID NO: 1406 - DNA, 25 bp, equine
agagtttttcactaccagttcctgt

SEQ ID NO: 1407 - DNA, 25 bp, equine
aactgttgctggctactggttacac

SEQ ID NO: 1408 - DNA, 25 bp, equine
attcttcatgtgcagtgtcgacagc

SEQ ID NO: 1409 - DNA, 25 bp, equine
gcacagattctgcattcagtggcaa

SEQ ID NO: 1410 - DNA, 25 bp, equine
tctggcttcaggaactcgggcataa

SEQ ID NO: 1411 - DNA, 25 bp, equine
aaagaccatgttggctgtccggagc

SEQ ID NO: 1412 - DNA, 25 bp, equine
tgtccggagcacacatggcttagaa

SEQ ID NO: 1413 - DNA, 25 bp, equine
tgaacatgcttcagatctccacgtt

SEQ ID NO: 1414 - DNA, 25 bp, equine
tctccacgttgctctgtaacattat

SEQ ID NO: 1415 - DNA, 25 bp, equine
tatttgttatccctgctctgcaatg

SEQ ID NO: 1416 - DNA, 25 bp, equine
aatgtagttccctgttagacccaag

SEQ ID NO: 1417 - DNA, 25 bp, equine
gtgacacatggctttcacttcacat

SEQ ID NO: 1418 - DNA, 25 bp, equine
atgagtgatgtctgccatgggcaca

SEQ ID NO: 1419 - DNA, 25 bp, equine
gttgcagatgtttgggatcctccct

SEQ ID NO: 1420 - DNA, 25 bp, equine
tgtgccctcaatatgctgtgtgtgc

SEQ ID NO: 1421 - DNA, 25 bp, equine
ctgtgtgtgccctttggatgaaact

SEQ ID NO: 1422 - DNA, 25 bp, equine
aagaatggaagcctctgggcctttc

SEQ ID NO: 1423 - DNA, 25 bp, equine
ggtgtggacagacttcttttcctca

SEQ ID NO: 1424 - DNA, 25 bp, equine
ggcttcttcacgtagaacccgggag

SEQ ID NO: 1425 - DNA, 25 bp, equine
attcagaatcgaatctcttctccct

SEQ ID NO: 1426 - DNA, 25 bp, equine
cttcctgtttttcggctttgtgaga

SEQ ID NO: 1427 - DNA, 25 bp, equine
gttaccaacaagacagatcctcgct

SEQ ID NO: 1428 - DNA, 25 bp, equine
gggaatctcaatactcttgtggtca

SEQ ID NO: 1429 - DNA, 25 bp, equine
aaatcgtgggttgctctgttcataa

SEQ ID NO: 1430 - DNA, 25 bp, equine
gctttgccttcgttcagtacgttaa

SEQ ID NO: 1431 - DNA, 25 bp, equine
aatgagagaaatgcccgtgctgctg

SEQ ID NO: 1432 - DNA, 25 bp, equine
gcagaatgatcgctggccaggtttt

SEQ ID NO: 1433 - DNA, 25 bp, equine
tcagctcctcttttgacttggacta

SEQ ID NO: 1434 - DNA, 25 bp, equine
ggatgtacagttacccagcacgtgt

SEQ ID NO: 1435 - DNA, 25 bp, equine
ttttggtccctacttccagcgtcat

SEQ ID NO: 1436 - DNA, 25 bp, equine
gtcattcctgcctatcactttggag

SEQ ID NO: 1437 - DNA, 25 bp, equine
ctgcctatcactttggagcgtgtgg

SEQ ID NO: 1438 - DNA, 25 bp, equine
cgagatttgggcattgccagcagtt

SEQ ID NO: 1439 - DNA, 25 bp, equine
cttgtttttcctgggcagcttcctt

SEQ ID NO: 1440 - DNA, 25 bp, equine
ggcagcttccttgggacagaaactt

SEQ ID NO: 1441 - DNA, 25 bp, equine
caaagtttttggtgacttgtggcta

SEQ ID NO: 1442 - DNA, 25 bp, equine
tgagtgtcctttttcccagggtggg

SEQ ID NO: 1443 - DNA, 25 bp, equine
acagccgccgtgctgcagccttgtg

SEQ ID NO: 1444 - DNA, 25 bp, equine
ggtccccagcttccctgatgtagga

SEQ ID NO: 1445 - DNA, 25 bp, equine
gcttccctgatgtaggaaccagatt

SEQ ID NO: 1446 - DNA, 25 bp, equine
gcagcttggaaacgcacggaaacct

SEQ ID NO: 1447 - DNA, 25 bp, equine
ggaaacctatactgaagcccaacaa

SEQ ID NO: 1448 - DNA, 25 bp, equine
gcgaggcgacctgtatcacggagat

SEQ ID NO: 1449 - DNA, 25 bp, equine
tgtcggtaatgatggcttgctggaa

SEQ ID NO: 1450 - DNA, 25 bp, equine
gaattccgcgacgaagcttgcagaa

SEQ ID NO: 1451 - DNA, 25 bp, equine
aaaagagatccaggccttcttcgat

SEQ ID NO: 1452 - DNA, 25 bp, equine
aggccttcttcgattgtgcttcgaa

SEQ ID NO: 1453 - DNA, 25 bp, equine
ggagaagccttttcaatgacgggac

SEQ ID NO: 1454 - DNA, 25 bp, equine
atgacgggactgtagcttttgagaa

SEQ ID NO: 1455 - DNA, 25 bp, equine
gcactgttatactttctttgcagag

SEQ ID NO: 1456 - DNA, 25 bp, equine
tgtcctttggaaccattgtctctgt

SEQ ID NO: 1457 - DNA, 25 bp, equine
gcacgagtcagtgttcgccatttca

SEQ ID NO: 1458 - DNA, 25 bp, equine
gccatttcacgttcggttcgggaag

SEQ ID NO: 1459 - DNA, 25 bp, equine
ggaagctgggagtcctgagatccaa

SEQ ID NO: 1460 - DNA, 25 bp, equine
gatatagaaatcaacggcgacgcag

SEQ ID NO: 1461 - DNA, 25 bp, equine
ggcgacgcagtggatcttcacatga

SEQ ID NO: 1462 - DNA, 25 bp, equine
agaagctttctttgtggaggagact

SEQ ID NO: 1463 - DNA, 25 bp, equine
atgaaaagcttcctgcttaccttgc

SEQ ID NO: 1464 - DNA, 25 bp, equine
acctcaccaattcctactgaagatc

SEQ ID NO: 1465 - DNA, 25 bp, equine
ttaaagatattgacacccgtttggt

SEQ ID NO: 1466 - DNA, 25 bp, equine
gaccatctcagagttcagacatctc

SEQ ID NO: 1467 - DNA, 25 bp, equine
gacatctcacacatcttagacacgg

SEQ ID NO: 1468 - DNA, 25 bp, equine
aagcgtgcccgcaaggagctgctca

SEQ ID NO: 1469 - DNA, 25 bp, equine
ggagctgctcaacttttacgcctgg

SEQ ID NO: 1470 - DNA, 25 bp, equine
ggcagcaccgcgagaccaagatgga

SEQ ID NO: 1471 - DNA, 25 bp, equine
aagatggagcatctcgcacagctgc

SEQ ID NO: 1472 - DNA, 25 bp, equine
agaggattgaactgatgcgggccca

SEQ ID NO: 1473 - DNA, 25 bp, equine
aatgctggtctcagaggctgtgccc

SEQ ID NO: 1474 - DNA, 25 bp, equine
cgtcaagccgcccaaagatctgagg

SEQ ID NO: 1475 - DNA, 25 bp, equine
gggtgaaggaccatgtcgccctcca

SEQ ID NO: 1476 - DNA, 25 bp, equine
attctggtgcttcagcagtcctggg

SEQ ID NO: 1477 - DNA, 25 bp, equine
agcatgaggacttggccttcaggaa

SEQ ID NO: 1478 - DNA, 25 bp, equine
ttcaggaagccactggcccaggagt

SEQ ID NO: 1479 - DNA, 25 bp, equine
gtgtttccactttggctctatcaca

SEQ ID NO: 1480 - DNA, 25 bp, equine
ttatttttggtaagtccctctgcag

SEQ ID NO: 1481 - DNA, 25 bp, equine
aagtccctctgcagtatcagctgga

SEQ ID NO: 1482 - DNA, 25 bp, equine
tggagtgtccttagtaccacagatt

SEQ ID NO: 1483 - DNA, 25 bp, equine
gattagcctagctccccatgagaga

SEQ ID NO: 1484 - DNA, 25 bp, equine
aggatccactagagggcgggttaca

SEQ ID NO: 1485 - DNA, 25 bp, equine
gagtagttgtgtacgcacgctcaca

SEQ ID NO: 1486 - DNA, 25 bp, equine
gtgcaaacaacccagacgtcgtcag

SEQ ID NO: 1487 - DNA, 25 bp, equine
gtaaaccaagtgtgctgtgtccata

SEQ ID NO: 1488 - DNA, 25 bp, equine
ttaactgacacatgccacaacggga

SEQ ID NO: 1489 - DNA, 25 bp, equine
accaggtaaaccactaggctgccgg

SEQ ID NO: 1490 - DNA, 25 bp, equine
gcaatggttctgtcatcggatctaa

SEQ ID NO: 1491 - DNA, 25 bp, equine
actgaataaccttccggtgatctcc

SEQ ID NO: 1492 - DNA, 25 bp, equine
ggtgatctccaacatgacggccaca

SEQ ID NO: 1493 - DNA, 25 bp, equine
gacggccacattagacagttgctca

SEQ ID NO: 1494 - DNA, 25 bp, equine
gttgctcagcagcagatggcagttt

SEQ ID NO: 1495 - DNA, 25 bp, equine
gcagtttggctgcagaaatgcccaa

SEQ ID NO: 1496 - DNA, 25 bp, equine
aactaattgctatacccactgcagc

SEQ ID NO: 1497 - DNA, 25 bp, equine
ttaccagcaccaccacagggacaat

SEQ ID NO: 1498 - DNA, 25 bp, equine
tccctcacgacgactgttgttcagg

SEQ ID NO: 1499 - DNA, 25 bp, equine
gttgttcaggccacaccaaagagtc

SEQ ID NO: 1500 - DNA, 25 bp, equine
gagtcctccattaaaacccattcaa

SEQ ID NO: 1501 - DNA, 25 bp, equine
ttggtgtgccaatcaaagtcctaca

SEQ ID NO: 1502 - DNA, 25 bp, equine
aggccgagggccacattgtgacatg

SEQ ID NO: 1503 - DNA, 25 bp, equine
ggtgtatcgtgggaagctcattgaa

SEQ ID NO: 1504 - DNA, 25 bp, equine
cggaggacaacatgaactgccagat

SEQ ID NO: 1505 - DNA, 25 bp, equine
gagcaggtgtacatccgcggcagca

SEQ ID NO: 1506 - DNA, 25 bp, equine
cagcaagatccgcttcctgattttg

SEQ ID NO: 1507 - DNA, 25 bp, equine
cctgattttgcctgacatgctgaaa

SEQ ID NO: 1508 - DNA, 25 bp, equine
aaagctgctattttgaaggcccaag

SEQ ID NO: 1509 - DNA, 25 bp, equine
gaacagaactttgcctctatttttt

SEQ ID NO: 1510 - DNA, 25 bp, equine
gggtgtgtgcttatgtatatgtcct

SEQ ID NO: 1511 - DNA, 25 bp, equine
tatgtcctaggttttcttttgtcaa

SEQ ID NO: 1512 - DNA, 25 bp, equine
tcgtgcttcctgattggctggagga

SEQ ID NO: 1513 - DNA, 25 bp, equine
gggctttgtcacctgagcagtgaat

SEQ ID NO: 1514 - DNA, 25 bp, equine
gtgaattaatgttggcatctgctcc

SEQ ID NO: 1515 - DNA, 25 bp, equine
ttggcatctgctccaaacacttgga

SEQ ID NO: 1516 - DNA, 25 bp, equine
aacacttggaggagagccacgattt

SEQ ID NO: 1517 - DNA, 25 bp, equine
ggaatcgtcctcatgcagcagatta

SEQ ID NO: 1518 - DNA, 25 bp, equine
gcagattatgttggctgatccccat

SEQ ID NO: 1519 - DNA, 25 bp, equine
atccgtgactgcgtgatgtttactg

SEQ ID NO: 1520 - DNA, 25 bp, equine
tgatgtttactgcacctggtgtgta

SEQ ID NO: 1521 - DNA, 25 bp, equine
gggcacagcgatgaacaaacagaca

SEQ ID NO: 1522 - DNA, 25 bp, equine
ggacttaccctggtggagttgacct

SEQ ID NO: 1523 - DNA, 25 bp, equine
aaaactgtgctgtccttgtgaggtc

SEQ ID NO: 1524 - DNA, 25 bp, equine
tgtgaggtcactgcctggacatggc

SEQ ID NO: 1525 - DNA, 25 bp, equine
gctgccttcctgtgcccagaaagga

SEQ ID NO: 1526 - DNA, 25 bp, equine
ggtcttcctcttaaggccagttgaa

SEQ ID NO: 1527 - DNA, 25 bp, equine
gttgaagatggtcccttgcagtttc

SEQ ID NO: 1528 - DNA, 25 bp, equine
ttgcagtttcccaagttaggttagt

SEQ ID NO: 1529 - DNA, 25 bp, equine
tagtgatgtgaaatgctcctgcccc

SEQ ID NO: 1530 - DNA, 25 bp, equine
aggcaattgctggttttcttcccca

SEQ ID NO: 1531 - DNA, 25 bp, equine
tcttccccaattcttttccaattag

SEQ ID NO: 1532 - DNA, 25 bp, equine
gcctcacccctgttgagtttttagt

SEQ ID NO: 1533 - DNA, 25 bp, equine
agtttttagtctcttgtgctgtgcc

SEQ ID NO: 1534 - DNA, 25 bp, equine
tgtacaccctctctgtgtctggaga

SEQ ID NO: 1535 - DNA, 25 bp, equine
gtgggacctacggaacatgggctac

SEQ ID NO: 1536 - DNA, 25 bp, equine
gggagtccagcctcaagtaccagac

SEQ ID NO: 1537 - DNA, 25 bp, equine
gggcatttccgaacaagcagggtta

SEQ ID NO: 1538 - DNA, 25 bp, equine
gtggcagttgagtacctggacccaa

SEQ ID NO: 1539 - DNA, 25 bp, equine
gaagtacgccttcaagtgtcacaga

SEQ ID NO: 1540 - DNA, 25 bp, equine
agatttacccggtcaatgccatttc

SEQ ID NO: 1541 - DNA, 25 bp, equine
aagcgactgtgtcagttccatcggt

SEQ ID NO: 1542 - DNA, 25 bp, equine
atcgcatcacttgccttcagtaatg

SEQ ID NO: 1543 - DNA, 25 bp, equine
gatgggactacacttgcaatagcat

SEQ ID NO: 1544 - DNA, 25 bp, equine
ggtatcttcattcgccaagtgacag

SEQ ID NO: 1545 - DNA, 25 bp, equine
atgaggtcaaagctgctcgagcccg

SEQ ID NO: 1546 - DNA, 25 bp, equine
gagccccttcacgtgatggatattg

SEQ ID NO: 1547 - DNA, 25 bp, equine
gccccgtcgctctgtggaaattgaa

SEQ ID NO: 1548 - DNA, 25 bp, equine
aattgaagccttctcacagcattgc

SEQ ID NO: 1549 - DNA, 25 bp, equine
gatttatgcatttggccgtcgtcaa

SEQ ID NO: 1550 - DNA, 25 bp, equine
tcaagggaacattgcccacttcaca

SEQ ID NO: 1551 - DNA, 25 bp, equine
gtacgtggcaactgaagctttcttg

SEQ ID NO: 1552 - DNA, 25 bp, equine
cttgtagtttgtttccctgtttgag

SEQ ID NO: 1553 - DNA, 25 bp, equine
gagatatctgaccttagcttttccc

SEQ ID NO: 1554 - DNA, 25 bp, equine
tgactttattgtttatccccttcac

SEQ ID NO: 1555 - DNA, 25 bp, equine
gtagccatggcagctttttgcagtg

SEQ ID NO: 1556 - DNA, 25 bp, equine
gcacaaaataaccaagaacatcctc

SEQ ID NO: 1557 - DNA, 25 bp, equine
agaacatcctcttttttggcagatt

SEQ ID NO: 1558 - DNA, 25 bp, equine
tttggcagatttgcctcaccctaaa

SEQ ID NO: 1559 - DNA, 25 bp, equine
atttgcctcaccctaaaattgaaag

SEQ ID NO: 1560 - DNA, 25 bp, equine
aattgaaaggttctgtttctgcaca

SEQ ID NO: 1561 - DNA, 25 bp, equine
ggttctgtttctgcacaggattttg

SEQ ID NO: 1562 - DNA, 25 bp, equine
cacaggattttgtaatatgagctat

SEQ ID NO: 1563 - DNA, 25 bp, equine
tatgagctataagcctcagatttgc

SEQ ID NO: 1564 - DNA, 25 bp, equine
taagcctcagatttgctctagtgcc

SEQ ID NO: 1565 - DNA, 25 bp, equine
tcagatttgctctagtgcccaaaat

SEQ ID NO: 1566 - DNA, 25 bp, equine
ctagtgcccaaaatttagagacttt

SEQ ID NO: 1567 - DNA, 25 bp, equine
tgaccttggagaacctcactgcaga

SEQ ID NO: 1568 - DNA, 25 bp, equine
tgatccctttttccaggttcaggtg

SEQ ID NO: 1569 - DNA, 25 bp, equine
aggttcaggtgttggtttcctcagc

SEQ ID NO: 1570 - DNA, 25 bp, equine
acaagagctctacgtggacacctgg

SEQ ID NO: 1571 - DNA, 25 bp, equine
ggacattccagccaacaccaagggt

SEQ ID NO: 1572 - DNA, 25 bp, equine
tgctcctcatattcctgaaggtgcc

SEQ ID NO: 1573 - DNA, 25 bp, equine
tcagtgccgtcctctgggtgaacag

SEQ ID NO: 1574 - DNA, 25 bp, equine
agagccagcctgaccaagaaaacct

SEQ ID NO: 1575 - DNA, 25 bp, equine
ctcgcccatcaatatcttgtgcaga

SEQ ID NO: 1576 - DNA, 25 bp, equine
agaccctgaatctgatatccctttt

SEQ ID NO: 1577 - DNA, 25 bp, equine
ttttcaccctattgccagagacttt

SEQ ID NO: 1578 - DNA, 25 bp, equine
gctgctatacattcaccggtaagaa

SEQ ID NO: 1579 - DNA, 25 bp, equine
agaagatctcatctcagaggctggg

SEQ ID NO: 1580 - DNA, 25 bp, equine
aagagcattgcgagagcgggcacca

SEQ ID NO: 1581 - DNA, 25 bp, equine
caatgtgtcagcagagcgtgccgaa

SEQ ID NO: 1582 - DNA, 25 bp, equine
aagcactcgctggagcttcatgagg

SEQ ID NO: 1583 - DNA, 25 bp, equine
ttgcgtgtcagttctgtgagctggc

SEQ ID NO: 1584 - DNA, 25 bp, equine
tggccgtgcgcctcagtaaggcaga

SEQ ID NO: 1585 - DNA, 25 bp, equine
gagatccatgagtaccactgtggca

SEQ ID NO: 1586 - DNA, 25 bp, equine
tggcccagcacaaggacgtgtgtca

SEQ ID NO: 1587 - DNA, 25 bp, equine
gagataagtattcccaccacgtgga

SEQ ID NO: 1588 - DNA, 25 bp, equine
taaatgtcgcacagtctcagagtct

SEQ ID NO: 1589 - DNA, 25 bp, equine
ggaaagccaagaattcctcctccat

SEQ ID NO: 1590 - DNA, 25 bp, equine
tccaagccaggctgctgaagatcaa

SEQ ID NO: 1591 - DNA, 25 bp, equine
ccagtggattggtcacctgctagac

SEQ ID NO: 1592 - DNA, 25 bp, equine
ggcagaatccccttactaagcagat

SEQ ID NO: 1593 - DNA, 25 bp, equine
gatttgctgaatccgctttgtatca

SEQ ID NO: 1594 - DNA, 25 bp, equine
ctgctttgtacatagggcgtgatcc

SEQ ID NO: 1595 - DNA, 25 bp, equine
ctgtgccaggaagccattgctcagt

SEQ ID NO: 1596 - DNA, 25 bp, equine
attgctcagttctacctttgttttt

SEQ ID NO: 1597 - DNA, 25 bp, equine
tgtactgctcagaatgtgtccctct

SEQ ID NO: 1598 - DNA, 25 bp, equine
attggtttaatggtgacgcctcctg

SEQ ID NO: 1599 - DNA, 25 bp, equine
gatctggtcacctgtgcatttgtga

SEQ ID NO: 1600 - DNA, 25 bp, equine
gaattaggcagatcaccgtctcttg

SEQ ID NO: 1601 - DNA, 25 bp, equine
gtctcttgtctacccagtttaacaa

SEQ ID NO: 1602 - DNA, 25 bp, equine
gacgcagacatgcagatctttgtga

SEQ ID NO: 1603 - DNA, 25 bp, equine
atctttgtgaagaccctgacgggca

SEQ ID NO: 1604 - DNA, 25 bp, equine
ggttgagcccagtgacaccattgag

SEQ ID NO: 1605 - DNA, 25 bp, equine
agcagcgtttgatttttgccggcaa

SEQ ID NO: 1606 - DNA, 25 bp, equine
ttttgccggcaaacagctggaggac

SEQ ID NO: 1607 - DNA, 25 bp, equine
cactctctcagactacaatatccag

SEQ ID NO: 1608 - DNA, 25 bp, equine
atttgccgcaagtgttatgctcgcc

SEQ ID NO: 1609 - DNA, 25 bp, equine
tcgtgctgtcaactgccgcaagaag

SEQ ID NO: 1610 - DNA, 25 bp, equine
gcaagaagaagtgcggccacaccaa

SEQ ID NO: 1611 - DNA, 25 bp, equine
aacctgcgccccaagaagaaggtca

SEQ ID NO: 1612 - DNA, 25 bp, equine
gaaggtcaaataaggcccctcctct

SEQ ID NO: 1613 - DNA, 25 bp, equine
gaagcttcttcccacctagaaagaa

SEQ ID NO: 1614 - DNA, 25 bp, equine
agaagtcctctctgagactcaaggg

SEQ ID NO: 1615 - DNA, 25 bp, equine
aagggctaaggcaaggtcttccaga

SEQ ID NO: 1616 - DNA, 25 bp, equine
acgccaatgggtcaaactaactctg

SEQ ID NO: 1617 - DNA, 25 bp, equine
tttccactgtcgtcagagccaacaa

SEQ ID NO: 1618 - DNA, 25 bp, equine
caagaaatgacagcctccaagcctt

SEQ ID NO: 1619 - DNA, 25 bp, equine
aagccttcctaaaagcacacttgcc

SEQ ID NO: 1620 - DNA, 25 bp, equine
ggtgacaacgctggctgctgaaagc

SEQ ID NO: 1621 - DNA, 25 bp, equine
aaagcccatgagctgcttctttgtt

SEQ ID NO: 1622 - DNA, 25 bp, equine
ttctttgttctctgtcacgggacaa

SEQ ID NO: 1623 - DNA, 25 bp, equine
aaaaatctctcatcctattctgctt

SEQ ID NO: 1624 - DNA, 25 bp, equine
agcattgtcattcctgtggcgtgcg

SEQ ID NO: 1625 - DNA, 25 bp, equine
tggcgtgcgcactcgtgactaagag

SEQ ID NO: 1626 - DNA, 25 bp, equine
ctcgtgactaagagcctggtcctta

SEQ ID NO: 1627 - DNA, 25 bp, equine
ttactgtcctgtttgctgtcacaca

SEQ ID NO: 1628 - DNA, 25 bp, equine
gaagtcatttggatcctaggcccat

SEQ ID NO: 1629 - DNA, 25 bp, equine
atgaggatgacctctgatctccatc

SEQ ID NO: 1630 - DNA, 25 bp, equine
atctacatccatctggcagttgtgc

SEQ ID NO: 1631 - DNA, 25 bp, equine
ggcagcgacatgagttggatccgtt

SEQ ID NO: 1632 - DNA, 25 bp, equine
acaaaggttatttctgaggctcagg

SEQ ID NO: 1633 - DNA, 25 bp, equine
ccctcatttcactgatgaccgtggg

SEQ ID NO: 1634 - DNA, 25 bp, equine
gctggattccgcctttgaggagcca

SEQ ID NO: 1635 - DNA, 25 bp, equine
gaggagccactcaccaagaagattt

SEQ ID NO: 1636 - DNA, 25 bp, equine
gaagattttcttcttctctgggcgc

SEQ ID NO: 1637 - DNA, 25 bp, equine
gtgtacacaggcaagtcggcgctag

SEQ ID NO: 1638 - DNA, 25 bp, equine
taggcccgaggcgtctggacaagct

SEQ ID NO: 1639 - DNA, 25 bp, equine
gtgtcagcccggtggaccagatgtt

SEQ ID NO: 1640 - DNA, 25 bp, equine
acgacgtcttccagtaccgagagaa

SEQ ID NO: 1641 - DNA, 25 bp, equine
actggcgcgtgagttcccggaatga

SEQ ID NO: 1642 - DNA, 25 bp, equine
aagtgggctacgtgagcttcgacct

SEQ ID NO: 1643 - DNA, 25 bp, equine
gaaggagccagtttgccggtttcaa

SEQ ID NO: 1644 - DNA, 25 bp, equine
ggtttcaaactggtgggtctgttct

SEQ ID NO: 1645 - DNA, 25 bp, equine
actgagcttttgtaagtcccgacac

SEQ ID NO: 1646 - DNA, 25 bp, equine
agcggtctggaagtgctgtcatcac

SEQ ID NO: 1647 - DNA, 25 bp, equine
atcatagctgccatagagttactgt

SEQ ID NO: 1648 - DNA, 25 bp, equine
gagttactgtttctccgtacataga

SEQ ID NO: 1649 - DNA, 25 bp, equine
agaggacagtgcttctgactggaat

SEQ ID NO: 1650 - DNA, 25 bp, equine
gttagcattcactttcaacgggaga

SEQ ID NO: 1651 - DNA, 25 bp, equine
tgtggtcaaatgttctctaggtcaa

SEQ ID NO: 1652 - DNA, 25 bp, equine
taggtcaaccttacatagcatactt

SEQ ID NO: 1653 - DNA, 25 bp, equine
agcaaaattggagcttctgagccca

SEQ ID NO: 1654 - DNA, 25 bp, equine
tgagcccaaatcactgtcactgttt

SEQ ID NO: 1655 - DNA, 25 bp, equine
tctttctttcaaactgtgctgcatg

SEQ ID NO: 1656 - DNA, 25 bp, equine
gctggacttccatcactgggtgaga

SEQ ID NO: 1657 - DNA, 25 bp, equine
gtgagaggctcaccctgtcatccaa

SEQ ID NO: 1658 - DNA, 25 bp, equine
gggacactgaatggcttcaacctac

SEQ ID NO: 1659 - DNA, 25 bp, equine
aatggcttcaacctactgggtgcgc

SEQ ID NO: 1660 - DNA, 25 bp, equine
agccaaggctactgcagctgtggtt

SEQ ID NO: 1661 - DNA, 25 bp, equine
gtccttagcggccaagatgatgtcc

SEQ ID NO: 1662 - DNA, 25 bp, equine
aagatgatgtccacggccgccattg

SEQ ID NO: 1663 - DNA, 25 bp, equine
ggtggccactctacagtccgtggga

SEQ ID NO: 1664 - DNA, 25 bp, equine
caaagtcatcctgggctccactggg

SEQ ID NO: 1665 - DNA, 25 bp, equine
tcatggcacccctgtaatagctcct

SEQ ID NO: 1666 - DNA, 25 bp, equine
tcagccccgcacaggagaggactgg

SEQ ID NO: 1667 - DNA, 25 bp, equine
agaacaacatcatcacagccgaggg

SEQ ID NO: 1668 - DNA, 25 bp, equine
tgggacgctgctgctgttcaggaaa

SEQ ID NO: 1669 - DNA, 25 bp, equine
gaagttcgggccagacatccaggat

SEQ ID NO: 1670 - DNA, 25 bp, equine
gagaatctttatgagggcctgaacc

SEQ ID NO: 1671 - DNA, 25 bp, equine
aacctcgatgactgttccatgtacg

SEQ ID NO: 1672 - DNA, 25 bp, equine
acatcggagacgtccagctggagaa

SEQ ID NO: 1673 - DNA, 25 bp, equine
atctgctgtgcttccaatttgtgtc

SEQ ID NO: 1674 - DNA, 25 bp, equine
tggaacgcggtcttttcacaatctt

SEQ ID NO: 1675 - DNA, 25 bp, equine
acaatctttcctgggagtgtcctga

SEQ ID NO: 1676 - DNA, 25 bp, equine
gggtaatgagcccttaatcgctgcc

SEQ ID NO: 1677 - DNA, 25 bp, equine
gattgtagcagcctcgttagtgcca

SEQ ID NO: 1678 - DNA, 25 bp, equine
tcgtcctcactgtttttaccttgac

SEQ ID NO: 1679 - DNA, 25 bp, equine
tttttaccttgacttcaactgccca

SEQ ID NO: 1680 - DNA, 25 bp, equine
gctggagctgattactgaactcgta

SEQ ID NO: 1681 - DNA, 25 bp, equine
tcgtatttaatctctattgccagtg

SEQ ID NO: 1682 - DNA, 25 bp, equine
tatttttctgattggtttcccctct

SEQ ID NO: 1683 - DNA, 25 bp, equine
tggtttcccctcttattggaagtat

SEQ ID NO: 1684 - DNA, 25 bp, equine
ggaatcatttgaggctttcaggtta

SEQ ID NO: 1685 - DNA, 25 bp, equine
ttagcaagagctatgggcgttacat

SEQ ID NO: 1686 - DNA, 25 bp, equine
ggcgttacatgcttgttttttccaa

SEQ ID NO: 1687 - DNA, 25 bp, equine
gggagctttggcatctttttagatt

SEQ ID NO: 1688 - DNA, 25 bp, equine
atctctattttcttaatccagggta

SEQ ID NO: 1689 - DNA, 25 bp, equine
gtaatatgatttccctttacttcct

SEQ ID NO: 1690 - DNA, 25 bp, equine
tacccttctgttaaactgctgctac

SEQ ID NO: 1691 - DNA, 25 bp, equine
gctgctactggagttcgcctttaaa

SEQ ID NO: 1692 - DNA, 25 bp, equine
gatttgaagtccttggcatcctgaa

SEQ ID NO: 1693 - DNA, 25 bp, equine
gttatatgccatgtgcttgttatga

SEQ ID NO: 1694 - DNA, 25 bp, equine
tatggtatgccaggagacattctcc

SEQ ID NO: 1695 - DNA, 25 bp, equine
gagacattctcctgattttcattat

SEQ ID NO: 1696 - DNA, 25 bp, equine
aatgctgttcttcttatcttttata

SEQ ID NO: 1697 - DNA, 25 bp, equine
atcaatttccgttgtttcgcttgtc

SEQ ID NO: 1698 - DNA, 25 bp, equine
ggtctacattaattttccccagtct

SEQ ID NO: 1699 - DNA, 25 bp, equine
taattttccccagtctgcattagaa

SEQ ID NO: 1700 - DNA, 25 bp, equine
aaggacctgtcctggctgattagtt

SEQ ID NO: 1701 - DNA, 25 bp, equine
ctgattagttgaggctgggacagct

SEQ ID NO: 1702 - DNA, 25 bp, equine
gacagctggaaggatgacatgacat

SEQ ID NO: 1703 - DNA, 25 bp, equine
tctacacagcgcattttggaggaca

SEQ ID NO: 1704 - DNA, 25 bp, equine
cccacactgggaaactctgctggtt

SEQ ID NO: 1705 - DNA, 25 bp, equine
aaactctgctggttcctggacgagg

SEQ ID NO: 1706 - DNA, 25 bp, equine
tgaccgtgcccttcgagaagcattc

SEQ ID NO: 1707 - DNA, 25 bp, equine
gaagcattcggccttgtagccagcc

SEQ ID NO: 1708 - DNA, 25 bp, equine
gaagaaagccgtggctgggccttct

SEQ ID NO: 1709 - DNA, 25 bp, equine
cggcgtttggcttcctttcagaaga

SEQ ID NO: 1710 - DNA, 25 bp, equine
ggcttcctttcagaagagctgccac

SEQ ID NO: 1711 - DNA, 25 bp, equine
caatatggtccatcgcggagcacgg

SEQ ID NO: 1712 - DNA, 25 bp, equine
caacctgcagtaccttcaagacgag

SEQ ID NO: 1713 - DNA, 25 bp, equine
cataggctttgtgctaagcggcgct

SEQ ID NO: 1714 - DNA, 25 bp, equine
aagcggcgctgggaacttcatggac

SEQ ID NO: 1715 - DNA, 25 bp, equine
gtggctttgcctacgtggagatcag

SEQ ID NO: 1716 - DNA, 25 bp, equine
gatcagccccaaagagatgaccgtc

SEQ ID NO: 1717 - DNA, 25 bp, equine
atgaccgtcacttacatcgaagctt

SEQ ID NO: 1718 - DNA, 25 bp, equine
aagcttcgggcaagtccctgttcaa

SEQ ID NO: 1719 - DNA, 25 bp, equine
ttcaagaccaggctgcccaggagag

SEQ ID NO: 1720 - DNA, 25 bp, equine
gaaagcagcatggacaccggccaga

SEQ ID NO: 1721 - DNA, 25 bp, equine
gagggaaattttctcctggattcag

SEQ ID NO: 1722 - DNA, 25 bp, equine
ggcacgagatccagtaccagctagt

SEQ ID NO: 1723 - DNA, 25 bp, equine
gctagtggacatctctcaggacaac

SEQ ID NO: 1724 - DNA, 25 bp, equine
aggacaacgccctgcgggatgagat

SEQ ID NO: 1725 - DNA, 25 bp, equine
gactatgagctcttcgtggaggctg

SEQ ID NO: 1726 - DNA, 25 bp, equine
gcaaaacacgctgcaggagttcctg

SEQ ID NO: 1727 - DNA, 25 bp, equine
gagttcctgaaactggcctaagcca

SEQ ID NO: 1728 - DNA, 25 bp, equine
gtgaccaattccctgttattcctaa

SEQ ID NO: 1729 - DNA, 25 bp, equine
tattcctaaccttctggccttggag

SEQ ID NO: 1730 - DNA, 25 bp, equine
tccttacccactagtctcagaaatt

SEQ ID NO: 1731 - DNA, 25 bp, equine
ctgacactggctgatgggcacctat

SEQ ID NO: 1732 - DNA, 25 bp, equine
gggcacctatgttggttccattagc

SEQ ID NO: 1733 - DNA, 25 bp, equine
atcggagctcatgatgggcggcacc

SEQ ID NO: 1734 - DNA, 25 bp, equine
aacacgctggtgctgcataacacat

SEQ ID NO: 1735 - DNA, 25 bp, equine
aacacatgtgaggactctctcctgg

SEQ ID NO: 1736 - DNA, 25 bp, equine
catgctggatctggtactgctgaca

SEQ ID NO: 1737 - DNA, 25 bp, equine
agaactgtgccagcgtgtgagcttc

SEQ ID NO: 1738 - DNA, 25 bp, equine
agcgcagctgcatcgagaacatcct

SEQ ID NO: 1739 - DNA, 25 bp, equine
agaacatcctaagggcctgcgtggg

SEQ ID NO: 1740 - DNA, 25 bp, equine
agaaccacatgcttctggagcacaa

SEQ ID NO: 1741 - DNA, 25 bp, equine
tggagcacaagatggagcgcccctg

SEQ ID NO: 1742 - DNA, 25 bp, equine
caacggctgtgtcggtgatgccaat

SEQ ID NO: 1743 - DNA, 25 bp, equine
aatggtcatacaaaggccgaggcac

SEQ ID NO: 1744 - DNA, 25 bp, equine
aaggagcgcaacgacacctgtgaca

SEQ ID NO: 1745 - DNA, 25 bp, equine
aagttcctgaaggagcggcttgctc

SEQ ID NO: 1746 - DNA, 25 bp, equine
gttaaatcgggctctctgtctcagc

SEQ ID NO: 1747 - DNA, 25 bp, equine
tagttacccattcacagatacccga

SEQ ID NO: 1748 - DNA, 25 bp, equine
gtctgtgcttgtcctttagtggata

SEQ ID NO: 1749 - DNA, 25 bp, equine
aagcattgagactagagccccgcct

SEQ ID NO: 1750 - DNA, 25 bp, equine
cccgccttcatgtagcatatgcttt

SEQ ID NO: 1751 - DNA, 25 bp, equine
gagcagtgccattttctggttagga

SEQ ID NO: 1752 - DNA, 25 bp, equine
tcagagaccgatgtacgtgcagcat

SEQ ID NO: 1753 - DNA, 25 bp, equine
ttttttgtgttgtcctttcgcatac

SEQ ID NO: 1754 - DNA, 25 bp, equine
gcatacccagtgttttaggcgtgtg

SEQ ID NO: 1755 - DNA, 25 bp, equine
ggatgtatgctcaaatgttctttta

SEQ ID NO: 1756 - DNA, 25 bp, equine
gttcttttaaatacctcctgatcaa

SEQ ID NO: 1757 - DNA, 25 bp, equine
tttacaacctactacagacacctgg

SEQ ID NO: 1758 - DNA, 25 bp, equine
tctgaccctccttactctatttttt

SEQ ID NO: 1759 - DNA, 25 bp, equine
ttgtgtttttgaaagcctgtctcct

SEQ ID NO: 1760 - DNA, 25 bp, equine
aagcctgtctcctcttgtgagaatg

SEQ ID NO: 1761 - DNA, 25 bp, equine
gaacatttagtcctgtttacgtttg

SEQ ID NO: 1762 - DNA, 25 bp, equine
ttacgtttgtactccagcaccaaga

SEQ ID NO: 1763 - DNA, 25 bp, equine
cagtacctgaacatagaatccacgt

SEQ ID NO: 1764 - DNA, 25 bp, equine
gggaagactgtttcaaccaagattt

SEQ ID NO: 1765 - DNA, 25 bp, equine
ggttggtgacatgcacttagggata

SEQ ID NO: 1766 - DNA, 25 bp, equine
gatccaaagattgaggtccctacca

SEQ ID NO: 1767 - DNA, 25 bp, equine
gaggtccctaccagaattatcaaaa

SEQ ID NO: 1768 - DNA, 25 bp, equine
taatcttcacaaacaagcatcggga

SEQ ID NO: 1769 - DNA, 25 bp, equine
tatgggttgtttgtgttacatcaga

SEQ ID NO: 1770 - DNA, 25 bp, equine
gataaacttcgactcttctgctttc

SEQ ID NO: 1771 - DNA, 25 bp, equine
tcgactcttctgctttcaattgaga

SEQ ID NO: 1772 - DNA, 25 bp, equine
agaggctgaaactgacatgtggaaa

SEQ ID NO: 1773 - DNA, 25 bp, equine
gtttcattcaggtcatcaaggctaa

SEQ ID NO: 1774 - DNA, 25 bp, equine
atctgaagtgaagaaccctcctcca

SEQ ID NO: 1775 - DNA, 25 bp, equine
agaaccctcctccaaatcaattggg

SEQ ID NO: 1776 - DNA, 25 bp, equine
ttcagcagaaacagctcagcacatt

SEQ ID NO: 1777 - DNA, 25 bp, equine
gaaggtctaccaagctgtgcagcat

SEQ ID NO: 1778 - DNA, 25 bp, equine
tgtgcagcataatcgagccacggaa

SEQ ID NO: 1779 - DNA, 25 bp, equine
ttatcttgtgttttactccctttca

SEQ ID NO: 1780 - DNA, 25 bp, equine
tactccctttcatgtgatgttgctg

SEQ ID NO: 1781 - DNA, 25 bp, equine
gatgttgctgattcgctgcattcta

SEQ ID NO: 1782 - DNA, 25 bp, equine
gttgcggatccaattctgtactgtt

SEQ ID NO: 1783 - DNA, 25 bp, equine
aaaattctgtactgggaggctcaac

SEQ ID NO: 1784 - DNA, 25 bp, equine
aaacgcataccgtctatgtctacaa

SEQ ID NO: 1785 - DNA, 25 bp, equine
gaagactgtgttccatctgagtgaa

SEQ ID NO: 1786 - DNA, 25 bp, equine
gtgaatattttaatcctctccagtg

SEQ ID NO: 1787 - DNA, 25 bp, equine
aaaacgcactgtattgctcctgact

SEQ ID NO: 1788 - DNA, 25 bp, equine
ggctgtgtaagtgacctaattaata

SEQ ID NO: 1789 - DNA, 25 bp, equine
aagagtatcgtcttcctacgcatag

SEQ ID NO: 1790 - DNA, 25 bp, equine
taggaagcttattctctggagacat

SEQ ID NO: 1791 - DNA, 25 bp, equine
attgatactctctgatttaatccag

SEQ ID NO: 1792 - DNA, 25 bp, equine
ccagatctgggcttatttaactaaa

SEQ ID NO: 1793 - DNA, 25 bp, equine
atattcgacactgctgattttttaa

SEQ ID NO: 1794 - DNA, 25 bp, equine
gatgcactgcacttttgatatgttt

SEQ ID NO: 1795 - DNA, 25 bp, equine
gccaaatatttaggtctgtcactga

SEQ ID NO: 1796 - DNA, 25 bp, equine
tagttttgtgaccttattctcccct

SEQ ID NO: 1797 - DNA, 25 bp, equine
ccccacttcctctgcaaaaagattt

SEQ ID NO: 1798 - DNA, 25 bp, equine
aaacgtggtttgcaaggcattctat

SEQ ID NO: 1799 - DNA, 25 bp, equine
agatatcctgccctgtgttttattc

SEQ ID NO: 1800 - DNA, 25 bp, equine
gttttattcctgtgtgttaacctca

SEQ ID NO: 1801 - DNA, 25 bp, equine
agcaagaaagtctgccctttgccat

SEQ ID NO: 1802 - DNA, 25 bp, equine
gcgtgtgcgcacgtacatgcatgag

SEQ ID NO: 1803 - DNA, 25 bp, equine
tgtggtttccagctttgctgacagt

SEQ ID NO: 1804 - DNA, 25 bp, equine
gagaacttagcctcctagtatccac

SEQ ID NO: 1805 - DNA, 25 bp, equine
cagtctcaactctggtttctcaaga

SEQ ID NO: 1806 - DNA, 25 bp, equine
aagatctgtcacgttggcctactaa

SEQ ID NO: 1807 - DNA, 25 bp, equine
gttggcctactaacttgacgtcttc

SEQ ID NO: 1808 - DNA, 25 bp, equine
gatcgcccagcgtttttagattgta

SEQ ID NO: 1809 - DNA, 25 bp, equine
ttatctcttgctttgttactttggg

SEQ ID NO: 1810 - DNA, 25 bp, equine
gcacctcgagtatcagttcattcat

SEQ ID NO: 1811 - DNA, 25 bp, equine
attgtgctgttaccatgactcacgc

SEQ ID NO: 1812 - DNA, 25 bp, equine
tgactcacgctctttgttgacagtt

SEQ ID NO: 1813 - DNA, 25 bp, equine
aggagcctgagaatcttggtccctc

SEQ ID NO: 1814 - DNA, 25 bp, equine
ctccaacctatgtggcccaagtaaa

SEQ ID NO: 1815 - DNA, 25 bp, equine
aaccaactccatttgttgctctgaa

SEQ ID NO: 1816 - DNA, 25 bp, equine
tctccagggttttctacctttgaca

SEQ ID NO: 1817 - DNA, 25 bp, equine
gagagatttgccctgtgttatcctg

SEQ ID NO: 1818 - DNA, 25 bp, equine
gtcattaggacagcttccttcttca

SEQ ID NO: 1819 - DNA, 25 bp, equine
gcacagcttccttagcatttagcat

SEQ ID NO: 1820 - DNA, 25 bp, equine
tttttagttctcctgcttttgcaat

SEQ ID NO: 1821 - DNA, 25 bp, equine
gacagctgctatgtactacttgaag

SEQ ID NO: 1822 - DNA, 25 bp, equine
gagatgttcttctcacaatgccagc

SEQ ID NO: 1823 - DNA, 25 bp, equine
aatgccagcctgttgaagattaaga

SEQ ID NO: 1824 - DNA, 25 bp, equine
gaatcattggctgggattatctccc

SEQ ID NO: 1825 - DNA, 25 bp, equine
tgacacaccctacaagctcttggat

SEQ ID NO: 1826 - DNA, 25 bp, equine
ggatgagacaattagctcctctgat

SEQ ID NO: 1827 - DNA, 25 bp, equine
caattagctcctctgattggttcag

SEQ ID NO: 1828 - DNA, 25 bp, equine
ctgtctgtgagaagttggctaatcc

SEQ ID NO: 1829 - DNA, 25 bp, equine
gtagtcagtgcattattttgcctca

SEQ ID NO: 1830 - DNA, 25 bp, equine
attttgcctcagctattatcctgca

SEQ ID NO: 1831 - DNA, 25 bp, equine
gagggcatacatcttgtggacgata

SEQ ID NO: 1832 - DNA, 25 bp, equine
tggtcacagcctccataaaactggt

SEQ ID NO: 1833 - DNA, 25 bp, equine
aactggtaggttttgctcaacatac

SEQ ID NO: 1834 - DNA, 25 bp, equine
tatttgtgagcaatggcctcgccta

SEQ ID NO: 1835 - DNA, 25 bp, equine
tcgcctacgtgttagcacatgtcga

SEQ ID NO: 1836 - DNA, 25 bp, equine
gggtacttcgatacacatggctaaa

SEQ ID NO: 1837 - DNA, 25 bp, equine
aacacttttgtatgtctttctgaaa

SEQ ID NO: 1838 - DNA, 25 bp, equine
gaagtaaaatgtcagcctctctcct

SEQ ID NO: 1839 - DNA, 25 bp, equine
gctgctggcttttaacttctttgta

SEQ ID NO: 1840 - DNA, 25 bp, equine
ggctattttatcgttttctcattgt

SEQ ID NO: 1841 - DNA, 25 bp, equine
taatgagtaacttctcccactgtgt

SEQ ID NO: 1842 - DNA, 25 bp, equine
ggatcgtctttactgttttactctc

SEQ ID NO: 1843 - DNA, 25 bp, equine
ttggtttgtttctactttcctgcta

SEQ ID NO: 1844 - DNA, 25 bp, equine
atatttccatttctctcgtgtgtac

SEQ ID NO: 1845 - DNA, 25 bp, equine
cttcctcctaactttgcatatcaaa

SEQ ID NO: 1846 - DNA, 25 bp, equine
ggaactcagattcagtgctacttct

SEQ ID NO: 1847 - DNA, 25 bp, equine
acttctatagtgttctgccatctca

SEQ ID NO: 1848 - DNA, 25 bp, equine
agtactcccagtgttgagtgcctca

SEQ ID NO: 1849 - DNA, 25 bp, equine
gagtgcctcagtattgcgcttacca

SEQ ID NO: 1850 - DNA, 25 bp, equine
taccagtttgccctggagctgttat

SEQ ID NO: 1851 - DNA, 25 bp, equine
ttctcctcctactgtgaatttctgg

SEQ ID NO: 1852 - DNA, 25 bp, equine
aggctctcatttttgtctgtcccaa

SEQ ID NO: 1853 - DNA, 25 bp, equine
ggaactctgtaagtcctttcgaacg

SEQ ID NO: 1854 - DNA, 25 bp, equine
tagagggtatcaatgcctggcccat

SEQ ID NO: 1855 - DNA, 25 bp, equine
aatgcctggcccatgttacatagaa

SEQ ID NO: 1856 - DNA, 25 bp, equine
aggcatgtacactttgatatagcag

SEQ ID NO: 1857 - DNA, 25 bp, equine
gatatagcaggttcaccttaggaaa

SEQ ID NO: 1858 - DNA, 25 bp, equine
gttcaggcattgctttaaacgatga

SEQ ID NO: 1859 - DNA, 25 bp, equine
tgaatttaacacatccatatactgg

SEQ ID NO: 1860 - DNA, 25 bp, equine
ggaagactatgtagccagcaagtaa

SEQ ID NO: 1861 - DNA, 25 bp, equine
agtaaattgacagtggagctccatt

SEQ ID NO: 1862 - DNA, 25 bp, equine
cagtggagctccattttacaaatgt

SEQ ID NO: 1863 - DNA, 25 bp, equine
gtgcagtcttacatgtgtacacata

SEQ ID NO: 1864 - DNA, 25 bp, equine
gaatacgtctggaatgatccattag

SEQ ID NO: 1865 - DNA, 25 bp, equine
gttctcttatggtcctacttctaaa

SEQ ID NO: 1866 - DNA, 25 bp, equine
gctttatgttaactgtgaggccgca

SEQ ID NO: 1867 - DNA, 25 bp, equine
tgaggccgcatgtgtccgtcactgg

SEQ ID NO: 1868 - DNA, 25 bp, equine
aggctgtcccagtgttaattgtatt

SEQ ID NO: 1869 - DNA, 25 bp, equine
tttacagcaggcctactagaccagc

SEQ ID NO: 1870 - DNA, 25 bp, equine
tagaccagcaggaagcatcgcacat

SEQ ID NO: 1871 - DNA, 25 bp, equine
gcatcgcacatgtcacattgcacat

SEQ ID NO: 1872 - DNA, 25 bp, equine
ttgcacatgggagctcaggtcctga

SEQ ID NO: 1873 - DNA, 25 bp, equine
gtcctgaagtcaggcttctgtctgt

SEQ ID NO: 1874 - DNA, 25 bp, equine
ctctgctgcctgtgttaatatttct

SEQ ID NO: 1875 - DNA, 25 bp, equine
taaactcttacctacgattactgtg

SEQ ID NO: 1876 - DNA, 25 bp, equine
aaagccattccagcatgtgtgtcct

SEQ ID NO: 1877 - DNA, 25 bp, equine
gtgctgcctctaatctaagctgggt

SEQ ID NO: 1878 - DNA, 25 bp, equine
aagcgaccctcgagattctgatgac

SEQ ID NO: 1879 - DNA, 25 bp, equine
gatgacagttttgccactgagccgt

SEQ ID NO: 1880 - DNA, 25 bp, equine
gtgaggcctgggacaagtattttct

SEQ ID NO: 1881 - DNA, 25 bp, equine
agtattttcttctctgcttcagttt

SEQ ID NO: 1882 - DNA, 25 bp, equine
gttttcctgagtacagtgtcaccat

SEQ ID NO: 1883 - DNA, 25 bp, equine
atatcacactagagacagccccttg

SEQ ID NO: 1884 - DNA, 25 bp, equine
gacagccccttgtaaagatcgtgtg

SEQ ID NO: 1885 - DNA, 25 bp, equine
gaagggctacatgatgctcctctgc

SEQ ID NO: 1886 - DNA, 25 bp, equine
acacactctcctgggtgtagctgga

SEQ ID NO: 1887 - DNA, 25 bp, equine
tgtccacgtcactgagtgctgtgag

SEQ ID NO: 1888 - DNA, 25 bp, equine
gagagcccagaggacactcacgtat

SEQ ID NO: 1889 - DNA, 25 bp, equine
actcacgtattcaggtgcccatttt

SEQ ID NO: 1890 - DNA, 25 bp, equine
agataaaagcatgccctttcctgtc

SEQ ID NO: 1891 - DNA, 25 bp, equine
ggtgcagttccatccattctgaatg

SEQ ID NO: 1892 - DNA, 25 bp, equine
aaaagtggagcctgccagtgctttc

SEQ ID NO: 1893 - DNA, 25 bp, equine
atttcactgtcgtggctggatagca

SEQ ID NO: 1894 - DNA, 25 bp, equine
gagggcaccatgtagtcctgacgca

SEQ ID NO: 1895 - DNA, 25 bp, equine
gacgcagtcctgtgtgattccgtga

SEQ ID NO: 1896 - DNA, 25 bp, equine
tttctgtaactgtccttccaaacca

SEQ ID NO: 1897 - DNA, 25 bp, equine
tctcaccaatggttgctgttacagt

SEQ ID NO: 1898 - DNA, 25 bp, equine
acgtcagtctaatagcacctgtcat

SEQ ID NO: 1899 - DNA, 25 bp, equine
cacctgtcatcttttctgcttagaa

SEQ ID NO: 1900 - DNA, 25 bp, equine
ttagaaccgcttatctcgaaacgat

SEQ ID NO: 1901 - DNA, 25 bp, equine
tgaaatcatgtcttgcacccttgag

SEQ ID NO: 1902 - DNA, 25 bp, equine
gtttagtctctgaataccttctcca

SEQ ID NO: 1903 - DNA, 25 bp, equine
gggacacattcattgaaccactcat

SEQ ID NO: 1904 - DNA, 25 bp, equine
aaccactcatggcacatcttagaag

SEQ ID NO: 1905 - DNA, 25 bp, equine
gcacattcatatcatagggagccga

SEQ ID NO: 1906 - DNA, 25 bp, equine
ggagccgactggttctcttattagt

SEQ ID NO: 1907 - DNA, 25 bp, equine
gtgtactatcagagtgtgctttcgc

SEQ ID NO: 1908 - DNA, 25 bp, equine
tgtgctttcgctcatctggatatac

SEQ ID NO: 1909 - DNA, 25 bp, equine
aagcagcgggacaaggtgtcttcta

SEQ ID NO: 1910 - DNA, 25 bp, equine
aattcacttgagtcctatgcattca

SEQ ID NO: 1911 - DNA, 25 bp, equine
ggcttgacaagaaccagactgcaga

SEQ ID NO: 1912 - DNA, 25 bp, equine
ggagaaagtttgcaaccccatcatt

SEQ ID NO: 1913 - DNA, 25 bp, equine
attaccaagctgtaccagagtgcag

SEQ ID NO: 1914 - DNA, 25 bp, equine
ggtttccctggtggtggagctcctc

SEQ ID NO: 1915 - DNA, 25 bp, equine
ggtggattaagccaacccgagcata

SEQ ID NO: 1916 - DNA, 25 bp, equine
gcatagatttagcattgttccacat

SEQ ID NO: 1917 - DNA, 25 bp, equine
tttgtagcaaattccatggcagttt

SEQ ID NO: 1918 - DNA, 25 bp, equine
ataactgggcattcttgatacttga

SEQ ID NO: 1919 - DNA, 25 bp, equine
gcactttataggcactgtattgtaa

SEQ ID NO: 1920 - DNA, 25 bp, equine
gctaaaggcaaattctctctcttga

SEQ ID NO: 1921 - DNA, 25 bp, equine
gcttttctgtttgttatgggtttat

SEQ ID NO: 1922 - DNA, 25 bp, equine
gaagtaccttttccaaattcatgag

SEQ ID NO: 1923 - DNA, 25 bp, equine
cacagctgaatatattcggccttca

SEQ ID NO: 1924 - DNA, 25 bp, equine
tcggccttcaacatggtcactagta

SEQ ID NO: 1925 - DNA, 25 bp, equine
aattgtcttcacagttctctcaagg

SEQ ID NO: 1926 - DNA, 25 bp, equine
gttctctcaagggagccaggctatt

SEQ ID NO: 1927 - DNA, 25 bp, equine
tgacaacagctctctcaaggcaaat

SEQ ID NO: 1928 - DNA, 25 bp, equine
caaggcaaatcctcttattttccaa

SEQ ID NO: 1929 - DNA, 25 bp, equine
gtgaccgacaaatcattaaccagaa

SEQ ID NO: 1930 - DNA, 25 bp, equine
gaaaacttggctgtgtaactgcatt

SEQ ID NO: 1931 - DNA, 25 bp, equine
gtagtggtatctcattgtagtctta

SEQ ID NO: 1932 - DNA, 25 bp, equine
gtagtcttaatttgcgtttcctcag

SEQ ID NO: 1933 - DNA, 25 bp, equine
tatgttctgtctttttatgtgctta

SEQ ID NO: 1934 - DNA, 25 bp, equine
tatgtgcttatttgccgcccatgta

SEQ ID NO: 1935 - DNA, 25 bp, equine
atgtatctctttctgcctatttttg

SEQ ID NO: 1936 - DNA, 25 bp, equine
gagtactagatctttagcagctatg

SEQ ID NO: 1937 - DNA, 25 bp, equine
aagtcccaatctatagcttgccttt

SEQ ID NO: 1938 - DNA, 25 bp, equine
gcttgccttttcatgctttcaggga

SEQ ID NO: 1939 - DNA, 25 bp, equine
gaaatctttgcctaaaccaacatca

SEQ ID NO: 1940 - DNA, 25 bp, equine
gattttctcttgtgttttcttctag

SEQ ID NO: 1941 - DNA, 25 bp, equine
tatccaattgttccatactgtttgt

SEQ ID NO: 1942 - DNA, 25 bp, equine
aaggtggccacctattttattgtga

SEQ ID NO: 1943 - DNA, 25 bp, equine
tttattgtgagctcttcctaggaag

SEQ ID NO: 1944 - DNA, 25 bp, equine
ggaaggctcctatttcagcagtttg

SEQ ID NO: 1945 - DNA, 25 bp, equine
cagcagtttggtctggctaacttta

SEQ ID NO: 1946 - DNA, 25 bp, equine
taagctgacgttggcaggcattcaa

SEQ ID NO: 1947 - DNA, 25 bp, equine
ggcattcaaattcatgtctccttgg

SEQ ID NO: 1948 - DNA, 25 bp, equine
gggccaatctgttctattttgtgcc

SEQ ID NO: 1949 - DNA, 25 bp, equine
aacttagctgtctcatcccaaaaat

SEQ ID NO: 1950 - DNA, 25 bp, equine
gtggttaagtttagtgcactcccct

SEQ ID NO: 1951 - DNA, 25 bp, equine
gtgacccgggttcacagatttggat

SEQ ID NO: 1952 - DNA, 25 bp, equine
ggatcctggatgcagacctaggcca

SEQ ID NO: 1953 - DNA, 25 bp, equine
aagacgtggctgatgcgcttctccg

SEQ ID NO: 1954 - DNA, 25 bp, equine
ggactgaccagtcactctcagaaaa

SEQ ID NO: 1955 - DNA, 25 bp, equine
aaaggctgaatctgcagaagctgca

SEQ ID NO: 1956 - DNA, 25 bp, equine
atagggcccagctgctggcagagca

SEQ ID NO: 1957 - DNA, 25 bp, equine
gactctcgctcttaaacttcaggaa

SEQ ID NO: 1958 - DNA, 25 bp, equine
ggaacaggaacgacttctcaaggaa

SEQ ID NO: 1959 - DNA, 25 bp, equine
gcaggagatgcaggctatccgaatg

SEQ ID NO: 1960 - DNA, 25 bp, equine
agcaccagctggagtatgtaacata

SEQ ID NO: 1961 - DNA, 25 bp, equine
atgtaatttcctaaccatctctcct

SEQ ID NO: 1962 - DNA, 25 bp, equine
tctctcctccacaagcaataagctg

SEQ ID NO: 1963 - DNA, 25 bp, equine
gatgcttccatttttgttgagctat

SEQ ID NO: 1964 - DNA, 25 bp, equine
atgtgttcataagtgccaaccgact

SEQ ID NO: 1965 - DNA, 25 bp, equine
gccaaccgactaattcatcaaacca

SEQ ID NO: 1966 - DNA, 25 bp, equine
aaaccaacttgatacttcagacctt

SEQ ID NO: 1967 - DNA, 25 bp, equine
cagaccttcaaaactgtggcctgaa

SEQ ID NO: 1968 - DNA, 25 bp, equine
gagatgtactctcagtggcagtatt

SEQ ID NO: 1969 - DNA, 25 bp, equine
gtattgaactgccttatctgtaaat

SEQ ID NO: 1970 - DNA, 25 bp, equine
tgtataaattatccgtccctcctga

SEQ ID NO: 1971 - DNA, 25 bp, equine
gggattattgccatcttacaccata

SEQ ID NO: 1972 - DNA, 25 bp, equine
gtagcttaatcataatctcacactg

SEQ ID NO: 1973 - DNA, 25 bp, equine
gaagattttgcatcacttttgctat

SEQ ID NO: 1974 - DNA, 25 bp, equine
gaatttacgccttaatgtgtcatta

SEQ ID NO: 1975 - DNA, 25 bp, equine
gtgtttaaaacaccgtctcaaatca

SEQ ID NO: 1976 - DNA, 25 bp, equine
actttgaattagtcttttggctcta

SEQ ID NO: 1977 - DNA, 25 bp, equine
ttggctctaaatttgccacttgaat

SEQ ID NO: 1978 - DNA, 25 bp, equine
gttcaccttattctataccagggct

SEQ ID NO: 1979 - DNA, 25 bp, equine
taccagggctggctattcagatgat

SEQ ID NO: 1980 - DNA, 25 bp, equine
aatgccatgtgccaatacttttcaa

SEQ ID NO: 1981 - DNA, 25 bp, equine
gccaatacttttcaaggtgcctttg

SEQ ID NO: 1982 - DNA, 25 bp, equine
aacgctcgagaacttaacacttatt

SEQ ID NO: 1983 - DNA, 25 bp, equine
atgatttgactgtatcctgtaccaa

SEQ ID NO: 1984 - DNA, 25 bp, equine
gtatcctgtaccaagactacttacc

SEQ ID NO: 1985 - DNA, 25 bp, equine
agactacttaccttgaatacaccag

SEQ ID NO: 1986 - DNA, 25 bp, equine
ccaacaggttggtctgatggtctga

SEQ ID NO: 1987 - DNA, 25 bp, equine
aatctgatgggcaggccttgcgatt

SEQ ID NO: 1988 - DNA, 25 bp, equine
gcatgcctgcttacttaatgactga

SEQ ID NO: 1989 - DNA, 25 bp, equine
aatgactgaaactgtgcacttttgt

SEQ ID NO: 1990 - DNA, 25 bp, equine
gtgcacttttgttctgacactgaat

SEQ ID NO: 1991 - DNA, 25 bp, equine
atttcctgttccataatagtagtta

SEQ ID NO: 1992 - DNA, 25 bp, equine
aagttttagcatgtccttagaggca

SEQ ID NO: 1993 - DNA, 25 bp, equine
ggcaagtatatgcttcaacacctaa

SEQ ID NO: 1994 - DNA, 25 bp, equine
ggtaccttctttgctgaatgtgaca

SEQ ID NO: 1995 - DNA, 25 bp, equine
gtgacagaatccataccagctcatg

SEQ ID NO: 1996 - DNA, 25 bp, equine
gttttcatctttacatatggcacat

SEQ ID NO: 1997 - DNA, 25 bp, equine
aaggataccatttttggctctccct

SEQ ID NO: 1998 - DNA, 25 bp, equine
agtacacagtttgacccagtggcca

SEQ ID NO: 1999 - DNA, 25 bp, equine
agtggccactggttcacagtacgcc

SEQ ID NO: 2000 - DNA, 25 bp, equine
tgaaacagtttgttcccaggccgtg

SEQ ID NO: 2001 - DNA, 25 bp, equine
agaatcctggagtggcatgctgacc

SEQ ID NO: 2002 - DNA, 25 bp, equine
aatggcttgcttctgcagaggatgc

SEQ ID NO: 2003 - DNA, 25 bp, equine
tgcctccagcttcttgcttaagaac

SEQ ID NO: 2004 - DNA, 25 bp, equine
aatttgttgattctctgctaggcct

SEQ ID NO: 2005 - DNA, 25 bp, equine
atcactttcttttctagttccttgg

SEQ ID NO: 2006 - DNA, 25 bp, equine
agttccttggttttcagctcaggct

SEQ ID NO: 2007 - DNA, 25 bp, equine
aggctgcattctctaactcatactg

SEQ ID NO: 2008 - DNA, 25 bp, equine
gaaaatacacccaagctccaaggct

SEQ ID NO: 2009 - DNA, 25 bp, equine
taatgagtcacccatccaggagatc

SEQ ID NO: 2010 - DNA, 25 bp, equine
ggagatcccaacgtactagcaagta

SEQ ID NO: 2011 - DNA, 25 bp, equine
agactgtcctaaatcctgatcaata

SEQ ID NO: 2012 - DNA, 25 bp, equine
acattgtgggcctcgaagtgctaca

SEQ ID NO: 2013 - DNA, 25 bp, equine
aggagtgcacacatcacctggagat

SEQ ID NO: 2014 - DNA, 25 bp, equine
gaacctgaatctgatcaagcctctg

SEQ ID NO: 2015 - DNA, 25 bp, equine
aagcctctggatcttgcttccaatt

SEQ ID NO: 2016 - DNA, 25 bp, equine
tgctcctaagtaattccatgtatgg

SEQ ID NO: 2017 - DNA, 25 bp, equine
gttaattatactcctctcttctttg

SEQ ID NO: 2018 - DNA, 25 bp, equine
tctcttctttggactgtgcttttga

SEQ ID NO: 2019 - DNA, 25 bp, equine
gatacttggacatctgcatcttcag

SEQ ID NO: 2020 - DNA, 25 bp, equine
tcagcttacaagatctacagtgcat

SEQ ID NO: 2021 - DNA, 25 bp, equine
gatttcattctttgttagctcactt

SEQ ID NO: 2022 - DNA, 25 bp, equine
tgtcaactcattactttttcctgtg

SEQ ID NO: 2023 - DNA, 25 bp, equine
gaattaactgtctgtctgccttgtc

SEQ ID NO: 2024 - DNA, 25 bp, equine
ctgccttgtcttagggtgttctgta

SEQ ID NO: 2025 - DNA, 25 bp, equine
ggtgttctgtagatcgattgccgat

SEQ ID NO: 2026 - DNA, 25 bp, equine
tcgattgccgatttcttaaacctga

SEQ ID NO: 2027 - DNA, 25 bp, equine
aaacctgaaatgatctttacactgt

SEQ ID NO: 2028 - DNA, 25 bp, equine
tattgacaccttttacagatcttaa

SEQ ID NO: 2029 - DNA, 25 bp, equine
gatcttaatgtagctttttccatat

SEQ ID NO: 2030 - DNA, 25 bp, equine
gttgatccagtttgtcctttaggtt

SEQ ID NO: 2031 - DNA, 25 bp, equine
gaatgtggccacagatgccttgctg

SEQ ID NO: 2032 - DNA, 25 bp, equine
atctgtcccctgaagacttgtgagg

SEQ ID NO: 2033 - DNA, 25 bp, equine
gtgaggtcctcttttgaaagccaaa

SEQ ID NO: 2034 - DNA, 25 bp, equine
agctaggacttcacattgccattca

SEQ ID NO: 2035 - DNA, 25 bp, equine
ttgccattcaaaactcttctctctt

SEQ ID NO: 2036 - DNA, 25 bp, equine
agaatgattgccttgctggtgtcct

SEQ ID NO: 2037 - DNA, 25 bp, equine
gaacggctttgacctgacggtgcct

SEQ ID NO: 2038 - DNA, 25 bp, equine
agggagcttgtctctagcgggttca

SEQ ID NO: 2039 - DNA, 25 bp, equine
gtgaacactttccactttctgacac

SEQ ID NO: 2040 - DNA, 25 bp, equine
ttctgacacctgatcctgatgtatg

SEQ ID NO: 2041 - DNA, 25 bp, equine
gtgttaaccatgaaagtactcgaag

SEQ ID NO: 2042 - DNA, 25 bp, equine
aagggtacatttctcctatggccga

SEQ ID NO: 2043 - DNA, 25 bp, equine
ctatggccgatttcaggaatttcaa

SEQ ID NO: 2044 - DNA, 25 bp, equine
gagaatccttcagttcattcacaaa

SEQ ID NO: 2045 - DNA, 25 bp, equine
ataaagccctggagggccctgaggc

SEQ ID NO: 2046 - DNA, 25 bp, equine
cctgaggctcactgctgactgagaa

SEQ ID NO: 2047 - DNA, 25 bp, equine
gactgagaactctgtggaacatgat

SEQ ID NO: 2048 - DNA, 25 bp, equine
ggaacatgatcctaggcactgaagt

SEQ ID NO: 2049 - DNA, 25 bp, equine
ggcactgaagtatcgaccactttcc

SEQ ID NO: 2050 - DNA, 25 bp, equine
accactttcctatttcacctgattt

SEQ ID NO: 2051 - DNA, 25 bp, equine
agaatgggaccatttctctgtgaat

SEQ ID NO: 2052 - DNA, 25 bp, equine
agaggactgcctcgcaatacttcgt

SEQ ID NO: 2053 - DNA, 25 bp, equine
aatacttcgtgctgttgctgctgac

SEQ ID NO: 2054 - DNA, 25 bp, equine
ctgcccatgtcagtgatcatcgtgg

SEQ ID NO: 2055 - DNA, 25 bp, equine
agctggacgctgatggtggacccct

SEQ ID NO: 2056 - DNA, 25 bp, equine
gcgtacacgctctgggaaggcatct

SEQ ID NO: 2057 - DNA, 25 bp, equine
aggcatctgcccgtgacatagtgca

SEQ ID NO: 2058 - DNA, 25 bp, equine
gacatagtgcagtttgtgccctacc

SEQ ID NO: 2059 - DNA, 25 bp, equine
agaagtacctgcacaactggtctcc

SEQ ID NO: 2060 - DNA, 25 bp, equine
tcaggcctagattcccttggagggt

SEQ ID NO: 2061 - DNA, 25 bp, equine
agggtaagctgtggccagtcctcag

SEQ ID NO: 2062 - DNA, 25 bp, equine
tatacttgttcctgctatttctgct

SEQ ID NO: 2063 - DNA, 25 bp, equine
tacactgtccaggatgagagccact

SEQ ID NO: 2064 - DNA, 25 bp, equine
atcattgtctcctgtggctgggaca

SEQ ID NO: 2065 - DNA, 25 bp, equine
agctgaagaccaatcacatcggcca

SEQ ID NO: 2066 - DNA, 25 bp, equine
aggctacctgaacactgtcactgtc

SEQ ID NO: 2067 - DNA, 25 bp, equine
gatccctctgtgcttctggaggcaa

SEQ ID NO: 2068 - DNA, 25 bp, equine
ggccaggccatgctttgggatttaa

SEQ ID NO: 2069 - DNA, 25 bp, equine
ggcaagcacctttacacactagatg

SEQ ID NO: 2070 - DNA, 25 bp, equine
gggacatcatcaacgccttgtgctt

SEQ ID NO: 2071 - DNA, 25 bp, equine
agaagttatcagtaccagcagcaag

SEQ ID NO: 2072 - DNA, 25 bp, equine
agactctgtttgctggctacacgga

SEQ ID NO: 2073 - DNA, 25 bp, equine
atcggcacccgctagaaatacatgg

SEQ ID NO: 2074 - DNA, 25 bp, equine
gtttctgaaaattctcttctctccc

SEQ ID NO: 2075 - DNA, 25 bp, equine
caacccctcagcttctggatataat

SEQ ID NO: 2076 - DNA, 25 bp, equine
gtgcataattgtgtatcctcctcaa

SEQ ID NO: 2077 - DNA, 25 bp, equine
gatgtttacacttttccagacgaga

SEQ ID NO: 2078 - DNA, 25 bp, equine
cagatcgtggatttcttttcctgta

SEQ ID NO: 2079 - DNA, 25 bp, equine
aacagattcttctcaccgatggtag

SEQ ID NO: 2080 - DNA, 25 bp, equine
gatggtcccaatatgtcagttgctg

SEQ ID NO: 2081 - DNA, 25 bp, equine
ctggtgcagtattctttccgtgata

SEQ ID NO: 2082 - DNA, 25 bp, equine
attggtggtcttgcctgtattttca

SEQ ID NO: 2083 - DNA, 25 bp, equine
cggtgcgttttatcggactgattca

SEQ ID NO: 2084 - DNA, 25 bp, equine
ataaagggtgctgctctgaggctag

SEQ ID NO: 2085 - DNA, 25 bp, equine
caaggcccgtgatttttctaccaga

SEQ ID NO: 2086 - DNA, 25 bp, equine
gtgatttttctaccagacctcactg

SEQ ID NO: 2087 - DNA, 25 bp, equine
taccagacctcactgcttttgtgtt

SEQ ID NO: 2088 - DNA, 25 bp, equine
gacctcactgcttttgtgtttagga

SEQ ID NO: 2089 - DNA, 25 bp, equine
ctcactgcttttgtgtttaggaaag

SEQ ID NO: 2090 - DNA, 25 bp, equine
gaaagagatcatatctgccccagct

SEQ ID NO: 2091 - DNA, 25 bp, equine
agagatcatatctgccccagctgga

SEQ ID NO: 2092 - DNA, 25 bp, equine
tgccccagctggatgtttcgaggat

SEQ ID NO: 2093 - DNA, 25 bp, equine
agctggatgtttcgaggatcctcct

SEQ ID NO: 2094 - DNA, 25 bp, equine
ggatgtttcgaggatcctcctccct

SEQ ID NO: 2095 - DNA, 25 bp, equine
ctcctccctctagacattggaagaa

SEQ ID NO: 2096 - DNA, 25 bp, equine
aatgcagattgagagctccctgtcc

SEQ ID NO: 2097 - DNA, 25 bp, equine
tgtcctcagccctgaactgggaatt

SEQ ID NO: 2098 - DNA, 25 bp, equine
aggagacttagctctacacgctcaa

SEQ ID NO: 2099 - DNA, 25 bp, equine
gtctctagccaaccaaactcacaag

SEQ ID NO: 2100 - DNA, 25 bp, equine
gtataagccagaggcccagtgtttc

SEQ ID NO: 2101 - DNA, 25 bp, equine
cagtgtttccaccaggcgtggagta

SEQ ID NO: 2102 - DNA, 25 bp, equine
agctctggagctgttagtgcctggt

SEQ ID NO: 2103 - DNA, 25 bp, equine
tagtgcctggtgtaactcttgcctc

SEQ ID NO: 2104 - DNA, 25 bp, equine
tagccctgtgattctgtgcaagtta

SEQ ID NO: 2105 - DNA, 25 bp, equine
tattgattgatctctctaagcctca

SEQ ID NO: 2106 - DNA, 25 bp, equine
taagcctcaatttcctcatctgtga

SEQ ID NO: 2107 - DNA, 25 bp, equine
aatgcagattgagagctccctgtcc

SEQ ID NO: 2108 - DNA, 25 bp, equine
tgtcctcagccctgaactgggaatt

SEQ ID NO: 2109 - DNA, 25 bp, equine
aggagacttagctctacacgctcaa

SEQ ID NO: 2110 - DNA, 25 bp, equine
gtctctagccaaccaaactcacaag

SEQ ID NO: 2111 - DNA, 25 bp, equine
gtataagccagaggcccagtgtttc

SEQ ID NO: 2112 - DNA, 25 bp, equine
cagtgtttccaccaggcgtggagta

SEQ ID NO: 2113 - DNA, 25 bp, equine
agctctggagctgttagtgcctggt

SEQ ID NO: 2114 - DNA, 25 bp, equine
tagtgcctggtgtaactcttgcctc

SEQ ID NO: 2115 - DNA, 25 bp, equine
tagccctgtgattctgtgcaagtta

SEQ ID NO: 2116 - DNA, 25 bp, equine
tattgattgatctctctaagcctca

SEQ ID NO: 2117 - DNA, 25 bp, equine
taagcctcaatttcctcatctgtga

SEQ ID NO: 2118 - DNA, 25 bp, equine
ggatgtgactcctggttatgttcag

SEQ ID NO: 2119 - DNA, 25 bp, equine
atgttcagtggacactctgcttaga

SEQ ID NO: 2120 - DNA, 25 bp, equine
agatagacgtgctccggaagatggc

SEQ ID NO: 2121 - DNA, 25 bp, equine
gatggcaggaactaccagcatggaa

SEQ ID NO: 2122 - DNA, 25 bp, equine
aaatgtgtcataggctggagggcta

SEQ ID NO: 2123 - DNA, 25 bp, equine
agacttttccttcttgttacactca

SEQ ID NO: 2124 - DNA, 25 bp, equine
gttacactcaacaagggcatgactt

SEQ ID NO: 2125 - DNA, 25 bp, equine
gacttaactgtgtattttgtcttta

SEQ ID NO: 2126 - DNA, 25 bp, equine
tgtctttacaatcctttagtgcctg

SEQ ID NO: 2127 - DNA, 25 bp, equine
ggctcatttaatgtatgcttgctca

SEQ ID NO: 2128 - DNA, 25 bp, equine
gtctgtttgcacatatttttaacca

SEQ ID NO: 2129 - DNA, 25 bp, equine
aagatctgatcttcaaagcagccag

SEQ ID NO: 2130 - DNA, 25 bp, equine
tggtaggcagaatgatgccctcccc

SEQ ID NO: 2131 - DNA, 25 bp, equine
gatgtccacactttaatctcctgaa

SEQ ID NO: 2132 - DNA, 25 bp, equine
gatgtgattaaggttaccctgcaga

SEQ ID NO: 2133 - DNA, 25 bp, equine
ccaggatttttcaggtgggctcaat

SEQ ID NO: 2134 - DNA, 25 bp, equine
aagagagaaccttcctagctgcttc

SEQ ID NO: 2135 - DNA, 25 bp, equine
atatgatgctctgtgctggttctga

SEQ ID NO: 2136 - DNA, 25 bp, equine
ggattgaagcaagcctgccaacact

SEQ ID NO: 2137 - DNA, 25 bp, equine
tgccaacacttcgattttagcctca

SEQ ID NO: 2138 - DNA, 25 bp, equine
ttagcctcaagagacccatacctga

SEQ ID NO: 2139 - DNA, 25 bp, equine
ccatacctgacttctgacctataga

SEQ ID NO: 2140 - DNA, 25 bp, equine
gctgctctgtcggtctgtacaaata

SEQ ID NO: 2141 - DNA, 25 bp, equine
aacacgactgggtctcgaatacaca

SEQ ID NO: 2142 - DNA, 25 bp, equine
gtttttgtgggtattgcctcattcc

SEQ ID NO: 2143 - DNA, 25 bp, equine
attccatccctgagctttgcaggta

SEQ ID NO: 2144 - DNA, 25 bp, equine
aactatgttccagggtgttccttgt

SEQ ID NO: 2145 - DNA, 25 bp, equine
tttgttgctctctttcctggaaata

SEQ ID NO: 2146 - DNA, 25 bp, equine
gagacgctcctgatttgtccatcta

SEQ ID NO: 2147 - DNA, 25 bp, equine
atctactgctttggttccttggatc

SEQ ID NO: 2148 - DNA, 25 bp, equine
atccacccattctttcactttaaga

SEQ ID NO: 2149 - DNA, 25 bp, equine
gaggtctctgtattttgcagctgcc

SEQ ID NO: 2150 - DNA, 25 bp, equine
tttgcagctgcccttttgtaagaag

What is claimed is:

1. A method for monitoring the immune response to an active herpes virus infection in a subject, comprising comparing expression of at least one herpes virus infection (HVI) marker polynucleotide in a biological sample obtained from the subject to expression of at least one corresponding HVI marker polynucleotide in a control biological sample obtained from a normal subject or from a subject lacking an active herpes virus infection, wherein a difference in the expression between the sample and the control indicates presence of an active herpes virus infection, wherein a similarity in the expression between the sample and the control indicates absence of an active herpes virus infection, wherein the at least one HVI marker polynucleotide is expressed in a primary infection by the herpes virus in cells of the immune system prior to detection of serum antibody to the herpes virus and is selected from the group consisting of: (a) a polynucleotide comprising a nucleotide sequence that shares at least 90% sequence identity with the sequence set forth in any one of SEQ ID NO: 1, 2, 4, 6, 7, 8, 10, 12, 13, 15, 17, 19, 21, 23, 24, 25, 26, 27, 29, 31, 33, 34, 35, 37, 38, 39, 41, 43, 45, 47, 49, 51, 53, 55, 57, 59, 61, 63, 65, 66, 67, 69, 71, 73, 75, 76, 77, 79, 81, 83, 84, 85, 87, 89, 91, 93, 94, 96, 98, 99, 100, 101, 102, 104, 106, 107, 108, 109, 111 or 113, or a complement thereof; (b) a polynucleotide comprising a nucleotide sequence that encodes a polypeptide comprising the amino acid sequence set forth in any one of SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114; and (c) a polynucleotide comprising a nucleotide sequence that encodes a polypeptide that shares at least 90% sequence identity with the sequence set forth in SEQ ID NO: 3, 5, 9, 11, 14, 16, 18, 20, 22, 28, 30, 32, 36, 40, 42, 44, 46, 48, 50, 52, 56, 58, 60, 62, 64, 68, 70, 72, 74, 78, 80, 82, 86, 88, 90, 92, 95, 97, 103, 105, 110, 112 or 114, wherein the difference in the expression between the sample and the control represents an at least 10% increase or decrease in the level of expression of the at least one HVI marker polynucleotide as compared to the level of expression of the or each corresponding HVI marker sol nucleotide and wherein the similarity in the expression between the sample and the control represents no more than a 5% increase or decrease in the level of expression of the at least one HVI marker polynucleotide as compared to the level of expression of the or each corresponding HVI marker polynucleotide.

2. A method according to claim 1, comprising: (1) measuring in the sample the level of the at least one HVI marker polynucleotide and (2) comparing the measured level of the at least one HVI marker polynucleotide to the level of a corresponding HVI marker polynucleotide in the control.

3. A method according to claim 2, wherein the presence of the active herpes virus infection is indicated when the measured level of the at least one HVI marker polynucleotide is at least 10% lower than the measured level of the or each corresponding HVI marker polynucleotide and the at least one HVI marker polynucleotide is selected from (a) a polynucleotide comprising a nucleotide sequence that shares at least 90% sequence identity with the sequence set forth in any one of SEQ ID NO: 6, 10, 19, 24, 25, 29, 33, 34, 35, 37, 38, 41, 53, 57, 61, 63, 65, 66, 73, 77, 83, 89, 93, 94, 96, 100, 101, 102, 104, 106, 107 or 108, or a complement thereof; (b) a polynucleotide comprising a nucleotide sequence that encodes a polypeptide comprising the amino acid sequence set forth in any one of SEQ ID NO: 11, 20, 30, 36, 42, 54, 58, 62, 64, 74, 78, 90, 95, 97, 103 or 105; and (c) a polynucleotide comprising a nucleotide sequence that encodes a polypeptide that shares at least 90% sequence identity with the sequence set forth in SEQ ID NO: 11, 20, 30, 36, 42, 54, 58, 62, 64, 74, 78, 90, 95, 97, 103 or 105.

4. A method according to claim 2, wherein the presence of the active herpes virus infection is indicated when the measured level of the at least one HVI marker polynucleotide is at least 10% higher than the measured level of the or each corresponding HVI marker polynucleotide and wherein the at least one HVI marker polynucleotide is selected from (a) a polynucleotide comprising a nucleotide sequence that shares at least 90% sequence identity with the sequence set forth in any one of SEQ ID NO: 1, 2, 4, 8, 12, 13, 15, 17, 21, 23, 26, 27, 31, 39, 43, 45, 47, 49, 51, 55, 59, 67, 69, 71, 75, 76, 79, 81, 85, 87, 91, 98, 99109, 111 or 113, or a complement thereof; (b) a polynucleotide comprising a nucleotide sequence that encodes a polypeptide comprising the amino acid sequence set forth in any one of SEQ ID NO: 3, 5, 9, 14, 16, 18, 22, 28, 32, 40, 44, 46, 48, 50, 52, 56, 60, 68, 70, 72, 80, 82, 86, 88, 92, 110, 112 or 114; and (c) a polynucleotide comprising a nucleotide sequence that encodes a polypeptide that shares at least 90% sequence identity with the sequence set forth in any one of SEQ ID NO: 3, 5, 9, 14, 16, 18, 22, 28, 32, 40, 44, 46, 48, 50, 52, 56, 60, 68, 70, 72, 80, 82, 86, 88, 92, 110, 112 or 114.

5. A method according to claim 2, further comprising diagnosing the absence of the active herpes virus infection when the measured level of the at least one HVI marker polynucleotide varies from the measured level of the or each corresponding HVI marker polynucleotide by no more than about 5%.

6. A method according to claim 2, wherein the at least one HVI marker polynucleotide or corresponding HVI marker polynucleotide is a target RNA or a DNA copy of the target RNA whose level is measured using at least one nucleic acid probe that hybridizes under high stringency conditions to the target RNA or to the DNA copy, wherein the nucleic acid probe comprises at least 15 contiguous nucleotides of an HVI marker polynucleotide.

7. A method according to claim 2, wherein the at least one HVI marker polynucleotide or corresponding HVI marker polynucleotide is a target RNA or a DNA copy of the target RNA whose level is measured using at least one nucleic acid probe that hybridizes under high stringency conditions to the target RNA or to the DNA copy, wherein the nucleic acid probe comprises a sequence as set forth in any one of SEQ ID NO: 145-2150.

8. A method according to claim 1, comprising measuring the level of at least two HVI marker polynucleotides.

9. A method according to claim 1, comprising measuring the level of at least three HVI marker polynucleotides.

10. A method according to claim 1, comprising measuring the level of at least four HVI marker polynucleotides.

11. A method according to claim 1, wherein the biological sample comprises blood.

12. A method according to claim 1, wherein the biological sample comprises peripheral blood.

13. A method according to claim 1, wherein the biological sample comprises leukocytes.

14. A method according to claim 1, wherein the at least one HVI marker polynucleotide is a RNA molecule.

* * * * *